United States Patent 7,745,391 (HUMAN THROMBOSPONDIN POLYPEPTIDE) - sequence listing, part 281

SEQ ID NO: 865537 - protein, 265 aa, Homo sapiens
MGIPNQGRGLYQGVKETRTYLLDGSWLVPEAKTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865538 - protein, 2111 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAVSGPVRKLYDDVQSEAGKLA

SEQ ID NO: 865539 - protein, 2070 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQHMPVPA

SEQ ID NO: 865540 - protein, 171 aa, Homo sapiens
MYTEQSMKAHREKTAIHKPRREASAETSLMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865541 - protein, 1921 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEENLDSQQFVIVIAECL

SEQ ID NO: 865542 - protein, 1110 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEEL

SEQ ID NO: 865543 - protein, 1214 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTANSQQPFR

SEQ ID NO: 865544 - protein, 1193 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWFNTGEKVRNNEDVGADGAQQAALRKKVDKLTMKNVEATSELTGDSEHNQ

SEQ ID NO: 865545 - protein, 1073 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLNFLHNCLPQNL

SEQ ID NO: 865546 - protein, 897 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKVVPGYPGPPLFAA

SEQ ID NO: 865547 - protein, 572 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITVRPLLVSAFK

SEQ ID NO: 865548 - protein, 129 aa, Homo sapiens
METLTSQCILLPTHTHTHLSHMHAYTHTHTHTHTHTYTHTHTRSLSLSLSLSVSVLSVWSGGRGGSSVLQHPSARRTHAPHPPRAERSPHRPRSLPSAGSDFCSSFFRIAPAMPASRRGRKSPGSPSIA

SEQ ID NO: 865549 - protein, 2510 aa, Homo sapiens; identical to SEQ ID NO: 865521

SEQ ID NO: 865550 - protein, 2329 aa, Homo sapiens
GCQVWEDLHLHCCYPESRPANATLSKSGNTFRPEVHLLPPPSEELALNELVTLTCLARGFGPKDVLVRWLQGSQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865551 - protein, 2490 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865552 - protein, 2892 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELLSRLRVLQSTNVHCYPIHSPSAASLEGLCPSRKMRWWEELPVRAAALAHKGRGRGAAVSVDDCLSHWLLPCAAVCSEWCWFSLLLVFVVDQPLSAANLKACSIVFLSRKEIICFSESALILGNSLLFYFTLGHLDLMMILVFFNFSFLLFVVFVFKDNISAFLYFSSRGLEYSLILKKSFKYTEWHRYSVLCLIFLLNLPKLSESWMYHFRNVLLIWRYNILYEDILKLSVPSPTSPQPGGSSENYKRQKNPLYTFCPASSSRLSTELHEPCVTVLSAWFQSLVVVLFKCRIGLGISVPGCSSHLVVNSTVCAYLSGCGVGTWDPRLHLITLLLGHHHYKLVAWNPHLGDTSWFAFMLDLQLTAFLVPLVTLLNSIRYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQAFQVLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865553 - protein, 1537 aa, Homo sapiens
CTLHAAVALRPPRLLDLQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQAFQVLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865554 - protein, 1257 aa, Homo sapiens
MDDEESWIKEKKLLVGSEDYGRDLTGVQNLRKKHKRLEAELAAHEPAVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQAFQVLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865555 - protein, 1101 aa, Homo sapiens
MDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKRSKLGESQTLQQFSRDVDEIEAWISEKLQTASDESYKDPTNIQAFQVLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865556 - protein, 861 aa, Homo sapiens
MGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865557 - protein, 887 aa, Homo sapiens
MGNASENGSYECFPFSSLRSSQIEALGEGRFFIDFISFWLPSVPQARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865558 - protein, 762 aa, Homo sapiens
MVSDDPCSDQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865559 - protein, 780 aa, Homo sapiens
MKGDHHGQIYLLQQLMLFQQVVHRSQVLPESSDASSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865560 - protein, 2518 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVSGHVAGHVPVLFPMLLNMLIFFTIDPQCLNM

SEQ ID NO: 865561 - protein, 437 aa, Homo sapiens
NDGPQLNDGPQLNDGPQLNDGPQLNDGPQLNDGPQLNDGPQLNDGPQLESLPKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865562 - protein, 215 aa, Homo sapiens
MRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865563 - protein, 2188 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAPELTARP

SEQ ID NO: 865564 - protein, 143 aa, Homo sapiens
MMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865565 - protein, 2080 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEHCQQGPEEPSQSCSLSPSVSLVFFCREETDQLWAWQRTYYQGRPLTAS

SEQ ID NO: 865566 - protein, 1633 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQAFQAAGCWS

SEQ ID NO: 865567 - protein, 1265 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKELNERWRSLQQLAEERSQLLGSAHEVQRFHRDADETREGIEKQDHSSTPSRAKT

SEQ ID NO: 865568 - protein, 1121 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQKDVLLHKLFLTLWTSLKYLVLISCPPPTGIL

SEQ ID NO: 865569 - protein, 1048 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKAPGTEIPC

SEQ ID NO: 865570 - protein, 420 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAALDAVRETAPVNSAVTLNYKDEYLMYDRGVGC

SEQ ID NO: 865571 - protein, 520 aa, Homo sapiens
MSAGEVERLVSELSGGTGGDEEEEWLYGDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 865572 - protein, 571 aa, Homo sapiens
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 865573 - protein, 594 aa, Homo sapiens
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 865574 - protein, 504 aa, Homo sapiens
MRRKSGSMAKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 865575 - protein, 552 aa, Homo sapiens
MAKADFLIEKPMQRNLHSDLAKYLEEKEVERPQEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 865576 - protein, 558 aa, Homo sapiens
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 865577 - protein, 493 aa, Homo sapiens
LGSTLSPDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 865578 - protein, 571 aa, Homo sapiens; identical to SEQ ID NO: 865572

SEQ ID NO: 865579 - protein, 571 aa, Homo sapiens; identical to SEQ ID NO: 865572

SEQ ID NO: 865580 - protein, 205 aa, Homo sapiens [sequence omitted]

SEQ ID NO: 865581 - protein, 205 aa, Homo sapiens [sequence omitted]

SEQ ID NO: 865582 - protein, 162 aa, Homo sapiens
ILSPAAHLYSCLCLSESFWWQADILCHRGSVITVLHQVFSTAMKNDTDTGNMQKEVMSVTEQVEKKKNDIEKDDTGRKRKPDISLLEVIVDVAMKVKKEIVTGDTNTKNLKEAKKEKKRAVSLPLNRRAPKLHLQNRHGFGLLCILVPEVDTINLVIFLDNV

SEQ ID NO: 865583 - protein, 130 aa, Homo sapiens
MSAGEVERLVSELSGGTGGDEEEEWLYGGPWDVHVHSDLAKDLDENEVEFLKSLTTKQKQKLLRKLDRLEKKKKKKDRKKKKFQKSRSKHKKHKSSSSSSSSSSSSSSTETSESSSESESNNKEKKIQRK

SEQ ID NO: 865584 - protein, 580 aa, Homo sapiens
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGIPITVPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 865585 - protein, 205 aa, Homo sapiens [sequence omitted]

SEQ ID NO: 865586 - protein, 571 aa, Homo sapiens; identical to SEQ ID NO: 865572

SEQ ID NO: 865587 - protein, 526 aa, Homo sapiens
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNAMKNDTDTGNMQKEVMSVTEQVEKKKNDIEKDDTGRKRKPDISLLEVIVDVAMKVKKEIVTGDTNTKNLKEAKKEKKRAVSLPLNRRAPKLHLQNRHGFGLLCILVPEVDTINLVIFLDNV

SEQ ID NO: 865588 - protein, 513 aa, Homo sapiens
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNAMKNDTDTGNMQKEVMSVTEQVEKKKNDIEKDDTGRKRKPDISLLEVIVDVAMKVKKEIVTGDTNTKNLKEAKKEKKRAVSLPLNRRAPKLHLQNRHGFGLLCILVPEVDTINLVIFLDNV

SEQ ID NO: 865589 - protein, 571 aa, Homo sapiens; identical to SEQ ID NO: 865572

SEQ ID NO: 865590 - protein, 135 aa, Homo sapiens [sequence omitted]

SEQ ID NO: 865591 - protein, 472 aa, Homo sapiens
MNGYGSPYLYMGGPVSQPPRAPLQRTPKCARCRNHGVLSWLKGHKRYCRFKDCTCEKCILIIERQRVMAAQVALRRQQANESLESLIPDSLRALPGPPPPGDAVAAPQPPPASQPSQPQPPRPAAELAAAAALRWTAEPQPGALQAQLAKPDLTEERLGDGKSADNTEVFSDKDTDQRSSPDVAKSKGCFTPESPEIVSVEEGGYAVQKNGGNPESRPDSPKCHAEQNHLLIEGPSGTVSLPFSLKANRPPLEVLKKIFPNQKPTVLELILKGCGGDLVSAVEVLLSSRSSVTGAERTSAEPESLALPSNGHIFEHTLSSYPISSSKWSVGSAFRVPDTLRFSADSSNVVPSPLAGPLQPPFPQPPRYPLMLRNTLARSQSSPFLPNDVTLWNTMTLQQQYQLRSQYVSPFPSNSTSVFRSSPVLPARATEDPRISIPDDGCPFVSKQSIYTEDDYDERSDSSDSRTLNTSS

SEQ ID NO: 865592 - protein, 335 aa, Homo sapiens [sequence omitted]

SEQ ID NO: 865593 - protein, 111 aa, Homo sapiens
SEHPVPGAFIGGNPPLSGPVFLGTRLWPGATNLLAPGAHTEWFKNLFQGPRPPTKFFFFFFFLRQSLAPSPMLECSGVISAHCNFRLLGSSYSPASAFQVTGITGMYHHTS

SEQ ID NO: 865594 - protein, 112 aa, Homo sapiens
SEHPVPGAFIGGNPPLSGPVFLGTPLSPVFISQGPAPTMCLYFSGSGGLTIFFFFFFFETESCSITHARVQWSDLGSLQLPPSGFKLFSCLSLPSNWDYRHVPPYQLIFLYF

SEQ ID NO: 865595 - protein, 111 aa, Homo sapiens; identical to SEQ ID NO: 865593

SEQ ID NO: 865596 - protein, 111 aa, Homo sapiens; identical to SEQ ID NO: 865593

SEQ ID NO: 865597 - protein, 111 aa, Homo sapiens; identical to SEQ ID NO: 865593

SEQ ID NO: 865598 - protein, 111 aa, Homo sapiens; identical to SEQ ID NO: 865593

SEQ ID NO: 865599 - protein, 111 aa, Homo sapiens; identical to SEQ ID NO: 865593

SEQ ID NO: 865600 - protein, 80 aa, Homo sapiens
RGGRSPGTHNPDHTAVTAAVAGAQTYHKSHKLTDGTPRGWTKAFCKATANNELTVDLNLKNIVTSLSNICKNYGIKLLMQ

SEQ ID NO: 865601 - protein, 111 aa, Homo sapiens; identical to SEQ ID NO: 865593

SEQ ID NO: 865602 - protein, 111 aa, Homo sapiens; identical to SEQ ID NO: 865593

SEQ ID NO: 865603 - protein, 111 aa, Homo sapiens; identical to SEQ ID NO: 865593

SEQ ID NO: 865604 - protein, 119 aa, Homo sapiens
MCSLDRERPNPCFPAAGARFFLWNPPHSRPVSWTLMDQCPYLLGPRAPPEWFNTLSWPAPPKIFFFFFFFLRQSLAPSPMLECSGVISAHCNFRLLGSSYSPASAFQVTGITGMYHHTS

SEQ ID NO: 865605 - protein, 111 aa, Homo sapiens; identical to SEQ ID NO: 865593

SEQ ID NO: 865606 - protein, 111 aa, Homo sapiens; identical to SEQ ID NO: 865593

SEQ ID NO: 865607 - protein, 111 aa, Homo sapiens; identical to SEQ ID NO: 865593

SEQ ID NO: 865608 - protein, 111 aa, Homo sapiens; identical to SEQ ID NO: 865593

SEQ ID NO: 865609 - protein, 111 aa, Homo sapiens; identical to SEQ ID NO: 865593

SEQ ID NO: 865610 - protein, 111 aa, Homo sapiens; identical to SEQ ID NO: 865593

SEQ ID NO: 865611 - protein, 111 aa, Homo sapiens; identical to SEQ ID NO: 865593

SEQ ID NO: 865612 - protein, 258 aa, Homo sapiens
MVGILPLCCSGCVPSLCCSSYVPSVAPTAAHSVRVPHSAGHCGQRVLACSLPQVFLKPWIFVEHFSSWLSLELFSFLRYLGTLLCACGHRLREGLLLPCLLGVGSWLLFNNWTGGSWFSLHLQQVSLSQGSHVAAFLPEAIGPGVPVPVSGESTSAQQSHAGWQLSAEADACPSVLYSEVLEWNKNINTYTSFHDFCLILGIFLFCFVLAVIGLPYIKPGLSLSVALLWQSLILLSSLVQQDSQVHTWGCLFSTFTST

SEQ ID NO: 865613 - protein, 120 aa, Homo sapiens
LVASAGAAAAVSAAGAAAAAGAAAPVAAAAAAGTATTVAAAGTAAVAAAGASAPVAAAGASAAGASASVAAAGTAAVAAAVAAAGASAAGASADVAAAETSAAASAASGTKRGEVTFGYL

SEQ ID NO: 865614 - protein, 121 aa, Homo sapiens
LVASAGAAAAVSAAGAAAAAGAAAPVAAAAAAGTATTVAAAGTAAVAAAGASAPVAAAGASAAGASASVAAAGTAAVAAAVAAAGASAAGASADVAAAETSAAASAASGTKRDGANTHYGD

SEQ ID NO: 865615 - protein, 120 aa, Homo sapiens; identical to SEQ ID NO: 865613

SEQ ID NO: 865616 - protein, 120 aa, Homo sapiens; identical to SEQ ID NO: 865613

SEQ ID NO: 865617 - protein, 120 aa, Homo sapiens; identical to SEQ ID NO: 865613

SEQ ID NO: 865618 - protein, 124 aa, Homo sapiens
ELSTLLFLADRVPIIGVFSAVMRLDGAVVPPGGWSPPLLPRAVFASCRLFARALPVIYLFVARLFLYTRWWFLVAPSVGIIYPPPLFFFFFSLSSFFFLFSFFFSFFFFFFFFFFIKDHNAIIY

SEQ ID NO: 865619 - protein, 119 aa, Homo sapiens
MGTRTLQFEISDSHEKEEDLLHKNHLMQDEIARLRLEIHTIKNQILEKKYLKDIEIIKRKHEDLQKALKQNGEKSTKTIAHYSGQLTALTDENTMLRSKLEKEKQSRQRLTKWNHTIVD

SEQ ID NO: 865620 - protein, 524 aa, Homo sapiens
CGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 865621 - protein, 565 aa, Homo sapiens
CGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKAHFRKAQALATLGKVEEALREFLYCVSLDGKNKRARCEAQRDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 865622 - protein, 158 aa, Homo sapiens
HTPNVHTDNKVALSLEHSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865623 - protein, 387 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865624 - protein, 387 aa, Homo sapiens; identical to SEQ ID NO: 865623

SEQ ID NO: 865625 - protein, 355 aa, Homo sapiens
YRGLGWKPLRASGVGGAGPDASVRFPVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865626 - protein, 456 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERCSPCGMVETSTSLTVYPFCRLKQAQGGMGFTQPSESGEWKGSDLGPARPRQTPFPVFYGGSMVFSDSTRYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865627 - protein, 394 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVGEAPTDPDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865628 - protein, 207 aa, Homo sapiens [sequence omitted]

SEQ ID NO: 865629 - protein, 502 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVGEAPTDPGAWTPPHPQDLIPHQYFSHRPSVPGIRSCSWPPPRLPLPIECFPHTHLVCRQRAHCLSVAWGMSLHLSDTPFPLLSPGEEIRWWVRKGLGYHRRGFYHPPPPPFMASQNSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865630 - protein, 375 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKLTHNKDVRDLFVDLVEKFVEPCRSDHWPLSDVRFFLNQYSASVHSLDGFRHQALWDRYMGTLRGCLLRLYHD

SEQ ID NO: 865631 - protein, 260 aa, Homo sapiens
MRRPSYCTSSSSRFRPPGRHYSSRGTMPLMRPLFGRCWARSCPKAPRKTWMTSAPKQASPSRAAGDRDYAAIVFFANNRFETGKKKLQYLSFGDFAFCAELMIQNWTLGAVGEAPTDPDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865632 - protein, 413 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKRDLVGAHGAGPAVGAQVAIGVTLSLCSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865633 - protein, 255 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVGLEGAQGASG

SEQ ID NO: 865634 - protein, 382 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVGEAPTDPDSQMDDMDMDLDKEFLQDLKELKVLVADKDLLDLHKSLVCTALRGKLGVFSEMEANFKLTHNKDVRDLFVDLVEKFVEPCRSDHWPLSDVRFFLNQYSASVHSLDGFRHQALWDRYMGTLRGCLLRLYHD

SEQ ID NO: 865635 - protein, 247 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQGMHCIHTDTASHLHFTPSLWPLAQFQPLIVAAASYLVFSSLPLSPPFFFFFFEMESCSVAQAGVQWRDLSSLQPPPPGFR

SEQ ID NO: 865636 - protein, 178 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLARILNLINPPPPAQHLSCWKLFPRGGAVCTMSEMAELSELYEESSDLQMDVMPGEGDLPQMEVGSGSRELSLRPSRSGAQQL

SEQ ID NO: 865637 - protein, 186 aa, Homo sapiens
MRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKRPVCGPRGEVCGTLPLRPLATQRRAVLPESVFSVCPLPRWLPTPGPLGPLHGHPPRLPPAPVS

SEQ ID NO: 865638 - protein, 357 aa, Homo sapiens
MTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865639 - protein, 387 aa, Homo sapiens; identical to SEQ ID NO: 865623

SEQ ID NO: 865640 - protein, 413 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRVSSPVLLSSLALPQPATCQDLASCRLKTPGPLGPLHGHPPRLPPAPVS

SEQ ID NO: 865641 - protein, 480 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKGLWSHPASDPWHLQPPVRHPYRAALPLPGIGRQVALLLPLVAADGSSSSTMGTWLMEGGGWIWGGACSSSPSFCAQLPTSGAESRAPRIPAPQNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865642 - protein, 320 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKKAELQGSLPHRTCPGGW

SEQ ID NO: 865643 - protein, 253 aa, Homo sapiens
MRRPSYCTSSSSRFRPPGRHYSSRGTMPLMRPLFGRCWARSCPKAPRKTWMTSAPKQASPSRAAGDRDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865644 - protein, 394 aa, Homo sapiens; identical to SEQ ID NO: 865627

SEQ ID NO: 865645 - protein, 506 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKRDLVGAHGAGPAVGAQVAIGVTLSLCSLVCTALRGKLGVFSEMEANFKGLWSHPASDPWHLQPPVRHPYRAALPLPGIGRQVALLLPLVAADGSSSSTMGTWLMEGGGWIWGGACSSSPSFCAQLPTSGAESRAPRIPAPQNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865646 - protein, 295 aa, Homo sapiens
KKEFQALRGPSSRLCRDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKGLWSHPASDPWHLQPPVRHPYRAALPLPGIGRQVALLLPLVAADGSSSYTMGTWLMEGGGWIWGGACSSSPSFCAQLPTSGAESRAPRIPAPQNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 865647 - protein, 178 aa, Homo sapiens
LGAPGSGLKAARQSRAVLAPARGAAAPGVAMTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFCHLYIVLQCW

SEQ ID NO: 865648 - protein, 272 aa, Homo sapiens
RGNNIDTTSWCIRPRYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVETYVLASPSRKISEESRGEEPEPRAPSPREK

SEQ ID NO: 865649 - protein, 1068 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDQFISDLEHQPSGSAEKWPNHSVLSCPAPFWRI

SEQ ID NO: 865650 - protein, 1068 aa, Homo sapiens; identical to SEQ ID NO: 865649

SEQ ID NO: 865651 - protein, 1075 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 865652 - protein, 1105 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDLFTSNNFDLASVETYVLASPSRKISEESRVNEIIGRDMSQISVSQGAGVSRQAPLPSPESLDLGRSDGL

SEQ ID NO: 865653 - protein, 596 aa, Homo sapiens
MFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 865654 - protein, 682 aa, Homo sapiens
WYTSSHQNAFWTALNSSTKYGPGGSFCTFILNMSQFVDPASFPPDGATVSIKPEPEDREPNFATIGLQDITLDELLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 865655 - protein, 676 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAPEAFL

SEQ ID NO: 865656 - protein, 280 aa, Homo sapiens
RGNNIDTTSWCIRPRYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 865657 - protein, 298 aa, Homo sapiens
RGNNIDTTSWCIRPRYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVETYVLASPSRKISEESRVNEIIGRDMSQISVSQGAGVSRQAPLPSPESLDLGRSDGL

SEQ ID NO: 865658 - protein, 1075 aa, Homo sapiens; identical to SEQ ID NO: 865651

SEQ ID NO: 865659 - protein, 1075 aa, Homo sapiens; identical to SEQ ID NO: 865651

SEQ ID NO: 865660 - protein, 915 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQMRKYGL

SEQ ID NO: 865661 - protein, 549 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKESKIRSSFDVVFDAQLLLSMGKKKVYGKHSRYLTTLTWKLLSIITTYNFLATSSHMALLTCRSTGKSSPWLGSLSSSKLCIL

SEQ ID NO: 865662 - protein, 205 aa, Homo sapiens
MFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSRGLSELLILGSQFHAWSVHGRCTRGGYHFPNPPFGTAMWTRREGNQRVGPVLQVLNTGAGAMGRSDAFYGRQQRVLCASQCGRHPSLVPPFW

SEQ ID NO: 865663 - protein, 1068 aa, Homo sapiens; identical to SEQ ID NO: 865649

SEQ ID NO: 865664 - protein, 1068 aa, Homo sapiens; identical to SEQ ID NO: 865649

SEQ ID NO: 865665 - protein, 1049 aa, Homo sapiens
SNPYFFLPDLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 865666 - protein, 1093 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVETYVLASPSRKISEESRVNEIIGRDMSQISVSQGAGVSRQAPLPSPESLDLGRSDGL

SEQ ID NO: 865667 - protein, 374 aa, Homo sapiens [sequence omitted]

SEQ ID NO: 865668 - protein, 271 aa, Homo sapiens
PACRNSLPSRHDFEKTTEGSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 865669 - protein, 1045 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDGKFISDMFLK

SEQ ID NO: 865670 - protein, 1067 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVETYVLASPSRKISEESRGEEPEPRAPSPREK

SEQ ID NO: 865671 - protein, 859 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDDQDSRMIRTADDQQQDDQDSRMIR

SEQ ID NO: 865672 - protein, 122 aa, Homo sapiens
MVQLRPRASRAPASAEAMVDEGQLASEEEEAEHGLLLGQPSSGAAAEPLEEDEEGDDEFDDEAPEELTFASAQAEAREEERRVRETVRRDKTLLKEKRKRREERVHRTEEKHQEIARKGERS

SEQ ID NO: 865673 - protein, 128 aa, Homo sapiens
MVQLRPRASRAPASAEAMVDEGQLASEEEEAEHGLLLGQPSSGAAAEPLEEDEEGDDEFDDEAPEELTFASAQAEAREEERRVRETVRRDKTLLKEKRKRREERVHRTEEKKTPSRHYFGEVNHSFTD

SEQ ID NO: 865674 - protein, 128 aa, Homo sapiens; identical to SEQ ID NO: 865673

SEQ ID NO: 865675 - protein, 128 aa, Homo sapiens; identical to SEQ ID NO: 865673

SEQ ID NO: 865676 - protein, 128 aa, Homo sapiens; identical to SEQ ID NO: 865673

SEQ ID NO: 865677 - protein, 128 aa, Homo sapiens; identical to SEQ ID NO: 865673

SEQ ID NO: 865678 - protein, 110 aa, Homo sapiens [sequence omitted]

SEQ ID NO: 865679 - protein, 128 aa, Homo sapiens; identical to SEQ ID NO: 865673

SEQ ID NO: 865680 - protein, 128 aa, Homo sapiens; identical to SEQ ID NO: 865673

SEQ ID NO: 865681 - protein, 128 aa, Homo sapiens; identical to SEQ ID NO: 865673

SEQ ID NO: 865682 - protein, 128 aa, Homo sapiens; identical to SEQ ID NO: 865673

SEQ ID NO: 865683 - protein, 128 aa, Homo sapiens; identical to SEQ ID NO: 865673

SEQ ID NO: 865684 - protein, 81 aa, Homo sapiens
LLLCPSPYLVSRIDFITKFWVPASGVPDETKRLLVLHPRCYFQNSGLVVWSLHCSMSLLSNLESSVFLPSGLSSTFHRLSF

SEQ ID NO: 865685 - protein, 550 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 865686 - protein, 550 aa, Homo sapiens; identical to SEQ ID NO: 865685

SEQ ID NO: 865687 - protein, 492 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 865688 - protein, 550 aa, Homo sapiens; identical to SEQ ID NO: 865685

SEQ ID NO: 865689 - protein, 550 aa, Homo sapiens; identical to SEQ ID NO: 865685

SEQ ID NO: 865690 - protein, 339 aa, Homo sapiens
MKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 865691 - protein, 550 aa, Homo sapiens; identical to SEQ ID NO: 865685

SEQ ID NO: 865692 - protein, 339 aa, Homo sapiens; identical to SEQ ID NO: 865690

SEQ ID NO: 865693 - protein, 339 aa, Homo sapiens; identical to SEQ ID NO: 865690

SEQ ID NO: 865694 - protein, 176 aa, Homo sapiens
RGLYQFGSSPDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 865695 - protein, 550 aa, Homo sapiens; identical to SEQ ID NO: 865685

SEQ ID NO: 865696 - protein, 550 aa, Homo sapiens; identical to SEQ ID NO: 865685

SEQ ID NO: 865697 - protein, 312 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQEDQSSTGFRLKTSSTRKYK

SEQ ID NO: 865698 - protein, 355 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQNPALLLPHECCGRQAIADGRWQCFQSVHPGLPALEFLGGLVGNAKSWPTQIYTIGSWRWNLT

SEQ ID NO: 865699 - protein, 83 aa, Homo sapiens
LATRRRCSVYRILSRASQPGQGRGARDRQPRPRTGRRKRNRREEEEGRDETTRQESKLSRGDLTAPPVSSPRGHRSSKKGGNT

SEQ ID NO: 865700 - protein, 83 aa, Homo sapiens; identical to SEQ ID NO: 865699

SEQ ID NO: 865701 - protein, 83 aa, Homo sapiens; identical to SEQ ID NO: 865699

SEQ ID NO: 865702 - protein, 215 aa, Homo sapiens
DARQPTRPRPGDLETGSLDEEPEGGKGTGGRKISRIDFITKFWVPASGVPDETKRLLVLHPRCYFQNSGLVVWSLHCSMSLLSNLESSVFLPSVRCAYFSLEKLEEAGMLEMRPSTPCLHGAALHLHSGHGSGSRLTNSSCFPGTRRLLALQFTQQTGTVGHPTWQPVIRAGVIGMTDLPWLSVHPSSEFSHLSKSWVCSSDFAARPLPGSGATL

SEQ ID NO: 865703 - protein, 117 aa, Homo sapiens
MPPPRTGRGLLWLGLVLSSVCVALGSETQANSTTGAAHALPAISSPFLPPFLPPSFFPSFFVYIHSFYPSSLLPFLLSSIIRSLPPFFTPSYRPFIPPFPLSIYSSIHLLSLRASLP

SEQ ID NO: 865704 - protein, 67 aa, Homo sapiens
SHRVAASREALGGHIRAPFSNSLSCSSLSLLGVLGSGVQCARRCTLSLGGSEQQRSDLWSDDERKCK

SEQ ID NO: 865705 - protein, 83 aa, Homo sapiens; identical to SEQ ID NO: 865699

SEQ ID NO: 865706 - protein, 550 aa, Homo sapiens; identical to SEQ ID NO: 865685

SEQ ID NO: 865707 - protein, 550 aa, Homo sapiens; identical to SEQ ID NO: 865685

SEQ ID NO: 865708 - protein, 550 aa, Homo sapiens; identical to SEQ ID NO: 865685

SEQ ID NO: 865709 - protein, 550 aa, Homo sapiens; identical to SEQ ID NO: 865685

SEQ ID NO: 865710 - protein, 584 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPALVGTHFSAEFCSQDLFLLALGLLQDDSSHHCVPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 865711 - protein, 460 aa, Homo sapiens
MPLRRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 865712 - protein, 153 aa, Homo sapiens
MDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 865713 - protein, 550 aa, Homo sapiens; identical to SEQ ID NO: 865685

SEQ ID NO: 865714 - protein, 343 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGFLMRTNT

SEQ ID NO: 865715 - protein, 382 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGTGRRGRHL

SEQ ID NO: 865716 - protein, 371 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHEKLSGRVFPPLAVKQLSPPYSGPPQRLHGMDLSQPN

SEQ ID NO: 865717 - protein, 191 aa, Homo sapiens
LATRRRCSVYRILSRASQPGQGRGARDRQPRPRTGRRKRNRREEEEGRDETTRQESKLSRGDLTAPPVSSPRGHRSSKKGGNIDWGPCSSRLSLAGLSPPGLLSCVLAAPSVPASGVQRDRFFNASFAVRCAYFSLEKLEEAEMLEMSCSSLSLLGVLGSGVQCARRCTLSLGGSEQQRSDLWSDDERKCK

SEQ ID NO: 865718 - protein, 80 aa, Homo sapiens
AWVAFGSFGGLPFGGPIGLRFVCCVCGLLSLFVLSLCFSCLTESCFVRSSCVAPWFAFSLTPRFALRVLDPLVSIVVSLP

SEQ ID NO: 865719 - protein, 179 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGTAPCPESGFSWFVVSESSIPILGMGLSLQSPLLAGRVPR

SEQ ID NO: 865720 - protein, 83 aa, Homo sapiens; identical to SEQ ID NO: 865699

SEQ ID NO: 865721 - protein, 215 aa, Homo sapiens; identical to SEQ ID NO: 865702

SEQ ID NO: 865722 - protein, 115 aa, Homo sapiens
MADMFCCGDAYLCFCSQQQAVCAPSRVSFLTGRRPDTTRLYDFNSYWRVHAGNFSTIPQYFKENGYVTMSVGKVFHPGTAPCPESGFSWFVVSESSIPILGMGLSLQSPLLAGRV

SEQ ID NO: 865723 - protein, 229 aa, Homo sapiens
MAPHGPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 865724 - protein, 191 aa, Homo sapiens
PSKGSRIPSSGRQSSKAVYRPRLICPFCLNQKDLLGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 865725 - protein, 229 aa, Homo sapiens; identical to SEQ ID NO: 865723

SEQ ID NO: 865726 - protein, 229 aa, Homo sapiens; identical to SEQ ID NO: 865723

SEQ ID NO: 865727 - protein, 205 aa, Homo sapiens [sequence omitted]

SEQ ID NO: 865728 - protein, 173 aa, Homo sapiens
MHPMSRERAKFVKSGLLLLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 865729 - protein, 229 aa, Homo sapiens; identical to SEQ ID NO: 865723

SEQ ID NO: 865730 - protein, 205 aa, Homo sapiens
MAPHGPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLFFGILGATTLSVSILLWATQRRKAKTS

SEQ ID NO: 865731 - protein, 171 aa, Homo sapiens
MLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 865732 - protein, 229 aa, Homo sapiens; identical to SEQ ID NO: 865723

SEQ ID NO: 865733 - protein, 229 aa, Homo sapiens; identical to SEQ ID NO: 865723

SEQ ID NO: 865734 - protein, 203 aa, Homo sapiens
MFLSLLQICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 865735 - protein, 311 aa, Homo sapiens
WRGPSFCEAATSASGRGEHRAEGVCSRLREAARRRGRPSLKGKRKRGSASIPERGLGRMKTSAELHEQEKPPSSPRATGPGRLGHARGRGPDALRGGAAGPGRASSGAPRERKMAPHGPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQVRN

SEQ ID NO: 865736 - protein, 211 aa, Homo sapiens
MAPHGPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGPCVPDGPGLLQCVCADGFHGYKCMRQGSFSLLMFFGILGATTLSVSILLWATQRRKAKTS

SEQ ID NO: 865737 - protein, 462 aa, Homo sapiens
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMGLACVVCRQMMVASGNQLVECQECHNLYHRDCHKPQVTDKEANDPRLVWYCARCTRQMKRMAQKTQKPPQKPAPAVVSVTPAVKDPLVKKPETKLKQETTFLAFKRTEVKTSTVISGNSSSASVSSSVTSGLTGWAAFAAKTSSAGPSTAKLSSTTQNNTGKPATSSANQKPVGLTGLATSSKGGIGSKIGSNNSTTPTVPLKPPPPLTLGKTGLSRSVSCDNVSKVGLPSPSSLVPGSSSQLSGNGNSGTSGPSGSTTSKTTSESSSSPSASLKGPTSQESQLNAMKRLQMVKKKAAQKKLKK

SEQ ID NO: 865738 - protein, 235 aa, Homo sapiens
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMGLACVVCRQMMVASGNQLVECQECHNLYHRDCHKPQVTDKEANDPRLVWYCARCTRQMKRMVNKLRKPRRNQPCSGL

SEQ ID NO: 865739 - protein, 462 aa, Homo sapiens; identical to SEQ ID NO: 865737

SEQ ID NO: 865740 - protein, 581 aa, Homo sapiens
MWKILAPAVIHNPADRKKGSNVTSYCRTAKRFPRPYCGNLCFPAFGAGQCGNRFRRDHREQTDRQGGAERSTQLHQVADLFMTAVESKLLSLYGYLPVKEGKVTEIREGNRKGGVKAFAMAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMGLACVVCRQMMVASGNQLVECQECHNLYHRDCHKPQVTDKEANDPRLVWYCARCTRQMKRMAQKTQKPPQKPAPAVVSVTPAVKDPLVKKPETKLKQETTFLAFKRTEVKTSTVISGNSSSASVSSSVTSGLTGWAAFAAKTSSAGPSTAKLSSTTQNNTGKPATSSANQKPVGLTGLATSSKGGIGSKIGSNNSTTPTVPLKPPPPLTLGKTGLSRSVSCDNVSKVGLPSPSSLVPGSSSQLSGNGNSGTSGPSGSTTSKTTSESSSSPSASLKGPTSQESQLNAMKRLQMVKKKAAQKKLKK

SEQ ID NO: 865741 - protein, 462 aa, Homo sapiens; identical to SEQ ID NO: 865737

SEQ ID NO: 865742 - protein, 444 aa, Homo sapiens
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKKPETQSSPITVQSSKDLPMADLSSFEETSADDFAMEMGLACVVCRQMMVASGNQLVECQECHNLYHRDCHKPQVTDKEANDPRLVWYCARCTRQMKRMAQKTQKPPQKPAPAVVSVTPAVKDPLVKKPETKLKQETTFLAFKRTEVKTSTVISGNSSSASVSSSVTSGLTGWAAFAAKTSSAGPSTAKLSSTTQNNTGKPATSSANQKPVGLTGLATSSKGGIGSKIGSNNSTTPTVPLKPPPPLTLGKTGLSRSVSCDNVSKVGLPSPSSLVPGSSSQLSGNGNSGTSGPSGSTTSKTTSESSSSPSASLKGPTSQESQLNAMKRLQMVKKKAAQKKLKK

SEQ ID NO: 865743 - protein, 233 aa, Homo sapiens
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMGLACVVCRQMMVASGNQLVECQECHNLYHRDCHKPQVTDKEANDPSKNQKPTEKTSPELVLELPVVKDPGLRNQK

SEQ ID NO: 865744 - protein, 462 aa, Homo sapiens; identical to SEQ ID NO: 865737

SEQ ID NO: 865745 - protein, 462 aa, Homo sapiens; identical to SEQ ID NO: 865737

SEQ ID NO: 865746 - protein, 584 aa, Homo sapiens
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVMTRRGLRDSHSSEEDEASSQTDLSQTISKKTVRSIQEAPAVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSSGYQKTPQEWAPQTARIRTRMQNDSILKSELGNQSPSTSSRQVTGQPQNASFVKRNRWWLLPLIAALASGSFWFFSTPEVETTAVQEFQNQMNQLKNKYQGQDEKLWKRSQTFLEKHLNSSHPRSQPAILLLTAARDAEEALRCLSEQIADAYSSFRSVRAIRIDGTDKATQDSDTVKLEVDQELSNGFKNGQNAAVVHRFESFPAGSTLIFYKYCDHENAAFKDVALVLTVLLEEETLGTSLGLKEVEEKVRDFLKVKFTNSNTPNSYNHMDPDKLNGLWSRISHLVLPVQPENALKRGICL

SEQ ID NO: 865747 - protein, 284 aa, Homo sapiens
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVMTRRGLRDSHSSEEDEASSQTDLSQTISKKTVRSIQEAPAVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSALL

SEQ ID NO: 865748 - protein, 584 aa, Homo sapiens; identical to SEQ ID NO: 865746

SEQ ID NO: 865749 - protein, 584 aa, Homo sapiens; identical to SEQ ID NO: 865746

SEQ ID NO: 865750 - protein, 584 aa, Homo sapiens; identical to SEQ ID NO: 865746

SEQ ID NO: 865751 - protein, 584 aa, Homo sapiens; identical to SEQ ID NO: 865746

SEQ ID NO: 865752 - protein, 584 aa, Homo sapiens; identical to SEQ ID NO: 865746

SEQ ID NO: 865753 - protein, 584 aa, Homo sapiens; identical to SEQ ID NO: 865746

SEQ ID NO: 865754 - protein, 584 aa, Homo sapiens; identical to SEQ ID NO: 865746

SEQ ID NO: 865755 - protein, 584 aa, Homo sapiens; identical to SEQ ID NO: 865746

SEQ ID NO: 865756 - protein, 782 aa, Homo sapiens
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGSSCLHFSFLSLDKHREWLEYLLEFAQDAAPIPNQYDKHFMERDYTGYVLALNGHKKYFCLFKPQKTVEEEEAIGSCSDVDSSLYLGESRGKPSCGLGSRPIKGKLSKLSLWMERLLEGSLQRFYIPSWPELD

SEQ ID NO: 865757 - protein, 782 aa, Homo sapiens; identical to SEQ ID NO: 865756

SEQ ID NO: 865758 - protein, 782 aa, Homo sapiens; identical to SEQ ID NO: 865756

SEQ ID NO: 865759 - protein, 782 aa, Homo sapiens; identical to SEQ ID NO: 865756

SEQ ID NO: 865760 - protein, 782 aa, Homo sapiens; identical to SEQ ID NO: 865756

SEQ ID NO: 865761 - protein, 595 aa, Homo sapiens
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSRFL

SEQ ID NO: 865762 - protein, 199 aa, Homo sapiens
MKAEGKKPISKIPKKGFVEVTELTDVTYTSNLVRLRPGHMNVVLILSNSTKTSLLQKFALEVYTFTGSSCLHFSFLSLDKHREWLEYLLEFAQDAAPIPNQYDKHFMERDYTGYVLALNGHKKYFCLFKPQKTVEEEEAIGSCSDVDSSLYLGESRGKPSCGLGSRPIKGKLSKLSLWMERLLEGSLQRFYIPSWPELD

SEQ ID NO: 865763 - protein, 160 aa, Homo sapiens [sequence omitted]

SEQ ID NO: 865764 - protein, 407 aa, Homo sapiens
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRNPGHFSTKLSDVPACPSGQRRFP

SEQ ID NO: 865765 - protein, 782 aa, Homo sapiens; identical to SEQ ID NO: 865756

SEQ ID NO: 865766 - protein, 782 aa, Homo sapiens; identical to SEQ ID NO: 865756

SEQ ID NO: 865767 - protein, 782 aa, Homo sapiens; identical to SEQ ID NO: 865756

SEQ ID NO: 865768 - protein, 782 aa, Homo sapiens; identical to SEQ ID NO: 865756

SEQ ID NO: 865769 - protein, 782 aa, Homo sapiens; identical to SEQ ID NO: 865756

SEQ ID NO: 865770 - protein, 782 aa, Homo sapiens; identical to SEQ ID NO: 865756

SEQ ID NO: 865771 - protein, 74 aa, Homo sapiens
ISAIESTRRRNCSWPLGGASFTDLMESSLGGPSVATSRLPGHFDTIQASCEEEVSTAVPTGRLSDAASTKEYTD

SEQ ID NO: 865772 - protein, 131 aa, Homo sapiens
LRVIDRPYRTTHYPPCHSQLLSPVSFPSFLQDPGTWVMVTLSHTTSAVILSDFAFHREIPAKPWTAHSMTSSFLGIVFLHPNSSTLPYSHAQDLFTQVTALCYLNSKNPTFQPPLLIFSLPIPKIIDPSIN

SEQ ID NO: 865773 - protein, 632 aa, Homo sapiens
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 865774 - protein, 127 aa, Homo sapiens
GEAWLHPEPRRTKGVVWQGWGRGRTETGGKGRGPGSCCEKGRDFFWRGSLSRPSLGSALSLLGTTSWRPPRPPPPLGAYSPPSCSWPAGRWWPPCWAPLTAWGSSISCCTRWTRQASGMAERTWPLC

SEQ ID NO: 865775 - protein, 632 aa, Homo sapiens; identical to SEQ ID NO: 865773

SEQ ID NO: 865776 - protein, 525 aa, Homo sapiens
MARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 865777 - protein, 686 aa, Homo sapiens
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGKEGPPPGAVGTIHQDAFTTHLLLVLLGAFGTLGVGAGFALGAKLCRPDAEVRHWSWETCCSLGPDATLTILGPLPTEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 865778 - protein, 495 aa, Homo sapiens
MAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 865779 - protein, 507 aa, Homo sapiens
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGLVPVWGRSFWLQPHRI

SEQ ID NO: 865780 - protein, 366 aa, Homo sapiens
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKALHKLQHEGTHISLHSLLGLPEDV

SEQ ID NO: 865781 - protein, 632 aa, Homo sapiens; identical to SEQ ID NO: 865773

SEQ ID NO: 865782 - protein, 383 aa, Homo sapiens
GEAWLHPEPRRTKGVVWQGWGRGRTETGGKGRGPWILLREGARFLLERFPVAPKSGKCPFSLRYHLMETPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYWQLFEELELRPRTWPGFPSSAEAHRGRRRGKAEGEERGPIGNRGDGPLGDRRNPRTGKTQHPHQMDNTGRGRR

SEQ ID NO: 865783 - protein, 698 aa, Homo sapiens
GEAWLHPEPRRTKGVVWQGWGRGRTETGGKGRGPWILLREGARFLLERFPVAPKSGKCPFSLRYHLMETPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 865784 - protein, 632 aa, Homo sapiens; identical to SEQ ID NO: 865773

SEQ ID NO: 865785 - protein, 612 aa, Homo sapiens
YGLSRPGIKKRQIMASAFLYMSETIVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 865786 - protein, 632 aa, Homo sapiens; identical to SEQ ID NO: 865773

SEQ ID NO: 865787 - protein, 256 aa, Homo sapiens
MLEEQEEASSPQLCPLPSPGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 865788 - protein, 34 aa, Homo sapiens
MGPLPTAFLSPTPGTVCDFRLSYGRVLSHSSKII

SEQ ID NO: 865789 - protein, 268 aa, Homo sapiens
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITEYTCSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDDVREYEKNMHEQTNIKVCNQHSSPVDDIESHAQTST

SEQ ID NO: 865790 - protein, 228 aa, Homo sapiens
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITEYTCSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYT

SEQ ID NO: 865791 - protein, 228 aa, Homo sapiens; identical to SEQ ID NO: 865790

SEQ ID NO: 865792 - protein, 245 aa, Homo sapiens
MISKHSHEQSDRGEGVEVVQNEPFEDPHHGNGQFTEKRVYLNSKLPSWARAVVPKIFYVTEKAWNYYPYTITEYTCSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDDVREYEKNMHEQTNIKVCNQHSSPVDDIESHAQTST

SEQ ID NO: 865793 - protein, 245 aa, Homo sapiens; identical to SEQ ID NO: 865792

SEQ ID NO: 865794 - protein, 175 aa, Homo sapiens [sequence omitted]

SEQ ID NO: 865795 - protein, 180 aa, Homo sapiens
NKGTCVFCNCVGIIVPSLLCHIKYFGDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDDVREYEKNMHEQTNIKVCNQHSSPVDDIESHAQTST

SEQ ID NO: 865796 - protein, 104 aa, Homo sapiens [sequence omitted]

SEQ ID NO: 865797 - protein, 104 aa, Homo sapiens [sequence omitted]

SEQ ID NO: 865798 - protein, 57 aa, Homo sapiens
MLLKEYRICMPLTVDEVSAAPGPASPAPGPPPLPPPPGRRAPGERQETQVDVTPQTR

SEQ ID NO: 865799 - protein, 268 aa, Homo sapiens; identical to SEQ ID NO: 865789

SEQ ID NO: 865800 - protein, 245 aa, Homo sapiens; identical to SEQ ID NO: 865792

SEQ ID NO: 865801 - protein, 245 aa, Homo sapiens; identical to SEQ ID NO: 865792

SEQ ID NO: 865802 - protein, 168 aa, Homo sapiens
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITEYTCSFLPKFSIHIETKYEDNKGSNDTIFDNEAKDVEREVCFIDIACDEIPERYYKESEDPELFKSAYTGQRG

SEQ ID NO: 865803 - protein, 104 aa, Homo sapiens [sequence omitted]

SEQ ID NO: 865804 - protein, 104 aa, Homo sapiens [sequence omitted]

SEQ ID NO: 865805 - protein, 259 aa, Homo sapiens
KANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSGAQRGRVIAVLKARELTPHGVLVDAAVVAKDTVVCTFENENTEWCLAVWRGWGAREFDIFYQSYEELGRLEACTRKRR

SEQ ID NO: 865806 - protein, 259 aa, Homo sapiens; identical to SEQ ID NO: 865805

SEQ ID NO: 865807 - protein, 259 aa, Homo sapiens; identical to SEQ ID NO: 865805

SEQ ID NO: 865808 - protein, 395 aa, Homo sapiens
MMAAKVVPMPPKPKQSFILRVPPDSKLGQDLLRDATNGPKTIHQLVLEHFLTFLPKPSLVQPSQKVKETLVIMKDVSSSLQNRVHPRPLVKLLPKGVQKEQETVSLYLKANPEELVVFEDLNVFHCQEECVSLDPTQQLTSEKEDDSSVGEMMLLAVNGSNPEGEDPEREPVENEDYREKSSDDDEMDSSLVSQQPPDNQEKERLNTSIPQKRKMRNLLVTIENDTPLEELSKYVDISIIALTRNRRTRRWYTCPLCGKQFNESSYLISHQRTHTGEKPYDCNHCGKSFNHKTNLNKHERIHTGEKPYSCSQCGKNFRQNSHRSRHEGIHIREKIFKCPECGKTFPKNEEFVLHLQSHEAERPYGCKKCGRRFGRLSNCTRHEKTHSACKTRKQK

SEQ ID NO: 865809 - protein, 395 aa, Homo sapiens; identical to SEQ ID NO: 865808

SEQ ID NO: 865810 - protein, 108 aa, Homo sapiens
MMAAKVVPMPPKPKQSFILRVPPDSKLGQDLLRDATNGPKTIHQLVLEHFLTFLPKPSLVQPSQKVKETLVIMKDVSSSLQNRGEKHMLVSLEEEEEVLESKIGFCVS

SEQ ID NO: 865811 - protein, 395 aa, Homo sapiens; identical to SEQ ID NO: 865808

SEQ ID NO: 865812 - protein, 103 aa, Homo sapiens
MNKTKFNLRLITREIDYKTAFKSLQEQNSHDAMDSYYDYIWDVTILEYLTYLHHKRGETDKRQIAIKAIGQTELNASNPEEVLQLAAQRRKKKFLQAMAKLYF

SEQ ID NO: 865813 - protein, 995 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSIWVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVIKRMIKCCSLLNCHTQVAILCQFLREIDYKTAFKSLQEQNSHDAMDSYYDYIWDVTILEYLTYLHHKRGETDKRQIAIKAIGQTELNASNPEEVLQLAAQRRKKKFLQAMAKLYF

SEQ ID NO: 865814 - protein, 777 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSIWVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLRGQGLDLSPKLEC

SEQ ID NO: 865815 - protein, 922 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSIWVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKEPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVIKRMIKCCSLLNCHTQVAILCQFLREIDYKTAFKSLQEQNSHDAMDSYYDYIWDVTILEYLTYLHHKRGETDKRQIAIKAIGQTELNASNPEEVLQLAAQRRKKKFLQAMAKLYF

SEQ ID NO: 865816 - protein, 970 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSIWVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVIKRMIKCCSLLNCHTQVAILCQFLREIDYKTAFKSLQEQNSHDAMDSYYDYIWDVTILEYLTYLHHKRGETDKRQIAVYKTSEGGRGKAA

SEQ ID NO: 865817 - protein, 696 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSIWVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKVVNV

SEQ ID NO: 865818 - protein, 951 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSIWVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNLCPLMFIQTSNKTNDKCCSLLNWHTQVAIYVSSQRNDYKTVNLCRTTSLKLGSNYDTMGLSLDNWLLPKGKRSTHWVSPAKLGGTKVLGRGKISRELRHLKGTGFFRAFKHSLFCVCCSS

SEQ ID NO: 865819 - protein, 639 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSIWVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHKKKKNTLRGGPGPHFALL

SEQ ID NO: 865820 - protein, 995 aa, Homo sapiens; identical to SEQ ID NO: 865813

SEQ ID NO: 865821 - protein, 780 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSIWVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLRVSFIKNCSNYYCWFL

SEQ ID NO: 865822 - protein, 320 aa, Homo sapiens
KTLPPKRKENKRNSEFILGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVIKRMIKCCSLLNCHTQVAILCQFLREIDYKTAFKSLQEQNSHDAMDSYYDYIWDVTILEYLTYLHHKRGETDKRQIAIKAIGQTELNASNPEEVLQLAAQRRKKKFLQAMAKLYF

SEQ ID NO: 865823 - protein, 909 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSIWVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVNCFRGLAGFLPTCICSSWVPFWLNLPISL

SEQ ID NO: 865824 - protein, 780 aa, Homo sapiens; identical to SEQ ID NO: 865821

SEQ ID NO: 865825 - protein, 165 aa, Homo sapiens
MKWGKKVACGSSEGTIYLFNWNGFGATSDRFALRAESIDCMVPVTESLLCTGSTDGVIRAVNILPNRVVGSVGQHTGEPVEELALSHCGRFLASSGHDQRLKFWDMAQLRAVVVDDYRRRKKKGGPLRALSSKTWSTDDFFAGLREEGEDSMAQEEKEETGDDSD

SEQ ID NO: 865826 - protein, 403 aa, Homo sapiens
SVGGSEADYPAAARLAVLLSMDRTCEERPAEDGSDEEDPDSMEAPTRIRDTPEDIVLEAPASGLAFHPARDLLAAGDVDGDVFVFSYSCQEGETKELWSSGHHLKACRAVAFSEDGQKLITVSKDKAIHVLDVEQGQLERRVSKAHGAPINSLLLVDENVLATGDDTGGIRLWDQRKEGPLMDMRQHEEYIADMALDPAKKLLLTASGDGCLGIFNIKRRRFELLSEPQSGDLTSVTLMKWGKKVACGSSEGTIYLFNWNGFGATSDRFALRAESIDCMVPVTESLLCTGSTDGVIRAVNILPNRVVGSVGQHTGEPVEELALSHCGRFLASSGHDQRLKFWDMAQLRAVVVDDYRRRKKKGGPLRALSSKTWSTDDFFAGLREEGEDSMAQEEKEETGDDSD

SEQ ID NO: 865827 - protein, 403 aa, Homo sapiens; identical to SEQ ID NO: 865826

SEQ ID NO: 865828 - protein, 403 aa, Homo sapiens; identical to SEQ ID NO: 865826

SEQ ID NO: 865829 - protein, 403 aa, Homo sapiens; identical to SEQ ID NO: 865826

SEQ ID NO: 865830 - protein, 403 aa, Homo sapiens; identical to SEQ ID NO: 865826

SEQ ID NO: 865831 - protein, 403 aa, Homo sapiens; identical to SEQ ID NO: 865826

SEQ ID NO: 865832 - protein, 403 aa, Homo sapiens; identical to SEQ ID NO: 865826

SEQ ID NO: 865833 - protein, 374 aa, Homo sapiens
SVGGSEADYPAAARLAVLLSMDRTCEERPAEDGSDEEDPDSMEAPTRIRDTPEDIVLEAPASGLAFHPARDLLAAGDVDGDVFVFSYSCQEGETKELWSSGHHLKACRAVAFSEDGQKLITVSKDKAIHVLDVEQGQLERRVSKAHGAPINSLLLVDENVLATGDDTGGIRLWDQRKEGPLMDMRQHEEYIADMALDPAKKLLLTASGDGCLGIFNIKRRRFELLSEPQSGDLTSVTLMKWGKKVACGSSEGTIYLFNWNGFGATSDRFALRAESIDCMVPVTESLLCTGSTDGVIRAVNILPNRVVGSVGQHTGEPVEELALSHCGRFLASSGHDQRLKFWDMAQLRAVVVDDYRRRKKKGGEEKEETGDDSD

SEQ ID NO: 865834 - protein, 317 aa, Homo sapiens
MEVSLMALSMSLSSDILSGAPTAGRGGGCSAALSPRGRGSKGLGTRAPGPRGDGQQPPLGTGGDEDPGAGSASAGGSRLAAAAAAEAAAPGDRSLCWAPRGRLLASSPAGEAGSWGRARRGGPRPGAPCKGLAGPPLRPGLRQVLKKSLRLRLRRLHRREAEAEAEAELGAAAPAAASAPHIAGTPAPGSPAGRPHARAVPRGSSRPPLLPPSFVTPRPHAPLAAFRWGFRAAPEPRTRLAGVRLGLPKTRRIQDRPLGLPRRWRCANDVIGPDSRECACVGASAFISTLRRFTPGKRSSERICGGQPRREKTGLKH

SEQ ID NO: 865835 - protein, 317 aa, Homo sapiens; identical to SEQ ID NO: 865834

SEQ ID NO: 865836 - protein, 317 aa, Homo sapiens; identical to SEQ ID NO: 865834

SEQ ID NO: 865837 - protein, 317 aa, Homo sapiens; identical to SEQ ID NO: 865834

SEQ ID NO: 865838 - protein, 317 aa, Homo sapiens; identical to SEQ ID NO: 865834

SEQ ID NO: 865839 - protein, 102 aa, Homo sapiens
RRGGLKLWRRAWPKALLSTGSVCVKLSAQMNDDRHVIQPERRGALAWLRGSDRMCYVEIYVITKVDSSSDRAEPSTFLVYWWERNLRMTIYPSPVRFFIRQR

SEQ ID NO: 865840 - protein, 317 aa, Homo sapiens; identical to SEQ ID NO: 865834

SEQ ID NO: 865841 - protein, 317 aa, Homo sapiens; identical to SEQ ID NO: 865834

SEQ ID NO: 865842 - protein, 317 aa, Homo sapiens; identical to SEQ ID NO: 865834

SEQ ID NO: 865843 - protein, 317 aa, Homo sapiens; identical to SEQ ID NO: 865834

SEQ ID NO: 865844 - protein, 85 aa, Homo sapiens
MSLSSDILSGAPTAGRGGGCSAALSPRGRGSKGLGTRAPGPRGDGQQPPLGTGGDEDPGAGSASAGGSRLAAAAAAEAAAPGDRS

SEQ ID NO: 865845 - protein, 274 aa, Homo sapiens
MAATKTASYDEHFRPEKLREWPEPESVSLMEVLAREDIDEAVCAILFKENSIVKRLDMYFQHVDTFKERRKEMLHKKWVENVAEPLQQRIMEKVISYKELKMKQENVEYYLQHRHKMVTVPPFVDPLFQRQQEVDEERRTGLQCETGKRHSIKELEEIEKARLHASSPYFTFTSHCVIPKEWHKASARARSKTYKYSPEKLICADKKQKRKEKKTADLSQAAFERQFLSSKLSQKNKVGENSLLNPSSEPQSLWELAKRVKNLTTQKFSEVRNG

SEQ ID NO: 865846 - protein, 298 aa, Homo sapiens
MAATKTASYDEHFRPEKLREWPEPESVSLMEVLAREDIDEAVCAILFKENSIVKRLDMYFQHVDTFKERRKEMLHKKWVENVAEPLQQRIMEKVISYKELKMKQENVEYYLQHRHKMVTVPPFVDPLFQRQQEVDEERRTGLQCETGKRHSIKELEEIEKARLHASSPYFTFTSHCVIPKEWHKASARARSKTYKYSPEKLICADKKQKRKEKKTADLSQAAFERQFLSSKLSQKNKVGERKGLVLGTRQQRPRSWAAGDSQQHRGPQPVGKRVMTAEVLGQHLASLQKVARQGHPWY

SEQ ID NO: 865847 - protein, 239 aa, Homo sapiens
SGRAPFSVAAPGRGLGGALPGRSRGACDFPRSWPEVLAREDIDEAVCAILFKENSIVKVTVPPFVDPLFQRQQEVDEERRTGLQCETGKRHSIKELEEIEKARLHASSPYFTFTSHCVIPKEWHKASARARSKTYKYSPEKLICADKKQKRKEKKTADLSQAAFERQFLSSKLSQKNKVGERKGLVLGTRQQRPRSWAAGDSQQHRGPQPVGKRVMTAEVLGQHLASLQKVARQGHPWY

SEQ ID NO: 865848 - protein, 339 aa, Homo sapiens
MAATKTASYDEHFRPEKLREWPEPESVSLMEVLAREDIDEAVCAILFKENSIVKVTVPPFVDPLFQRQQEVDEERRTGLQCETGKRHSIKELEEIEKARLHASSPYFTFTSHCVIPKEWHKASARARSKTYKYSPEKLICADKKQKRKEKKTADLSQAAFERQFLSSKLSQKNKVGERKGLVSRGLGRGWLQGFAAPTSSTYWFQNEPPPQPSLSDRHPRAEEAWPKKKGVKRRREKWRWPQAQHCSSDRAPRAGKPCMKKLRQVVNVGPGPHFPETSCPSEVRANLATGAFPPEISSAPSPGPLPFCHFPTIFHLLHPNCTKDGVLLSPHTTGGKFLK

SEQ ID NO: 865849 - protein, 235 aa, Homo sapiens
MAATKTASYDEHFRPEKLREWPEPESVSLMEVLAREDIDEAVCAILFKENSIVKVTVPPFVDPLFQRQQEVDEERRTGLQCETGKRHSIKELEEIEKARLHASSPYFTFTSHCVIPKEWHKASARARSKTYKYSPEKLICADKKQKRKEKKTADLSQAAFERQFLSSKLSQKNKVGERKGLVLGTRQQRPRSWAAGDSQQHRGPQPVGKRVMTAEVLGQHLASLQKVARQGHPWY

SEQ ID NO: 865850 - protein, 199 aa, Homo sapiens
MAATKTASYDEHFRPEKLREWPEPESVSLMEVLAREDIDEAVCAILFKENSIVKRLDMYFQHVDTFKERRKEMLHKKWVENVAEPLQQRIMEKVISYKELKMKQENVEYYLQHRHKMVTVPPFVDPLFQRQQEVDEERRTGLQCETGKRHSIKELEEIEKARLHASSPYFTFTSHCVIPKEWHKASARARSKTYKYRYR

SEQ ID NO: 865851 - protein, 269 aa, Homo sapiens
RGARAPASQVGARPWPWRKSRRSRRPAPGDAASRSPRGRDRAAGIMTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 865852 - protein, 224 aa, Homo sapiens
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 865853 - protein, 269 aa, Homo sapiens; identical to SEQ ID NO: 865851

SEQ ID NO: 865854 - protein, 224 aa, Homo sapiens; identical to SEQ ID NO: 865852

SEQ ID NO: 865855 - protein, 269 aa, Homo sapiens; identical to SEQ ID NO: 865851

SEQ ID NO: 865856 - protein, 332 aa, Homo sapiens
RGARAPASQVGARPWPWRKSRRSRRPAPGDAASRSPRGRDRAAGIMTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVGTAARGARTTRGEPGLEQEQDQQGDGQDGTVRTVCGGDDDRTGDKREAIHADLECFHANSFKIGAGHK

SEQ ID NO: 865857 - protein, 269 aa, Homo sapiens
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCVQQPGAQTPEKGHLGSTGVLEGRGSKPGLKVSEYWRIPSFAFLSCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 865858 - protein, 184 aa, Homo sapiens
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVME

SEQ ID NO: 865859 - protein, 148 aa, Homo sapiens
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCVQQPGAQTPEKGHLGSTGVLEGRGSKPGAEGV

SEQ ID NO: 865860 - protein, 245 aa, Homo sapiens
GGANNSVVRGSVVNSAEALAVAKEPAEPETRSRRRRLAIPARAGPGGRHHDPVSLRELLRSCLLPLLHHLQVQRPVSAGRARGGEGAGPGPTLTSRFSRSEYNAFWKCVQAGVTYLFVQLCKVRATGKPRVLAPRLCRPRGTRAHGELIPRNADATDREDTTHRDIPDTYEERIRIPRRGTATRKSRRHEPVQAQKTPRTAQLVDASHHYGTSLKHNPAAKTHKHKHTQVDHHNHRGQETSGGKE

SEQ ID NO: 865861 - protein, 172 aa, Homo sapiens
MTLFHFGNCFALAYFPYFITYKCSGLSEYNAFWKCVQAGVTYLFVQLCKVRATGKPRVLAPRLCRPRGTRAHGELIPRNADATDREDTTHRDIPDTYEERIRIPRRGTATRKSRRHEPVQAQKTPRTAQLVDASHHYGTSLKHNPAAKTHKHKHTQVDHHNHRGQETSGGKE

SEQ ID NO: 865862 - protein, 224 aa, Homo sapiens; identical to SEQ ID NO: 865852

SEQ ID NO: 865863 - protein, 297 aa, Homo sapiens
GGANNSVVRGSVVNSAEALAVAKEPAEPETRSRRRRLAIPARAGPGGRHHDPVSLRELLRSCLLPLLHHLQVQRPVSAGRARGGEGAGPGPTLTSRFSRSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 865864 - protein, 242 aa, Homo sapiens
IFCHQDPTSNLPVLMNSNSIPPIPLRPTHTRQVDLTITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 865865 - protein, 172 aa, Homo sapiens
MGLPVPLCLLKPQPDPQEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 865866 - protein, 179 aa, Homo sapiens
MPARESTRSWLLPWAGPLLSLLCPGAYSSLEPRPLRRDTWVPRGCWRAGAQSLVLKVSEYWRIPSFAFLSCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 865867 - protein, 184 aa, Homo sapiens
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVGSRALPHTHFCWRPYSSPRPGPDFLPPSRSITSSRLLRSG

SEQ ID NO: 865868 - protein, 136 aa, Homo sapiens
WLAEGHESYPAGEGGIDDCVGEFMKASVDVADLIGLNLVMSRNAGKGEYKIMVAALGWATAELIMSRCIPLWVGARGIEFDWKYIQMSIDSNISLVGSRALPHTHFCWRPYSSPRPGPDFLPPSRSITSSRLLRSG

SEQ ID NO: 865869 - protein, 360 aa, Homo sapiens
MAEPDLECEQIRLKCIRKEGFFTVPPEHRLGRCRSVKEFEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLPCEPELMPTFPHHRNKRAAPATSEGQSKRCKP

SEQ ID NO: 865870 - protein, 208 aa, Homo sapiens
RLRLRAREAGPALGMAEPDLECEQIRLKCIRKEGFFTVPPEHRLGRCRSVKEFEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTGGCNLGQALSLDGTW

SEQ ID NO: 865871 - protein, 173 aa, Homo sapiens
TGNTLLFQLGRCRSVKEFEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTGGCNLGQALSLDGTW

SEQ ID NO: 865872 - protein, 123 aa, Homo sapiens
MDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTGGCNLGQALSLDGTW

SEQ ID NO: 865873 - protein, 183 aa, Homo sapiens
MERGPALPGGFTRTLGASLAEVPVPPSAETRREPLGVGRCCPDRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTGGCNLGQALSLDGTW

SEQ ID NO: 865874 - protein, 123 aa, Homo sapiens; identical to SEQ ID NO: 865872

SEQ ID NO: 865875 - protein, 237 aa, Homo sapiens
RLRLRAREAGPALGMAEPDLECEQIRLKCIRKEGFFTVPPEHRLGRCRSVKEFEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMW

SEQ ID NO: 865876 - protein, 272 aa, Homo sapiens
MDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLRLPISGVCEGCREPG

SEQ ID NO: 865877 - protein, 289 aa, Homo sapiens
MDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLPCEPELMPTFPHHRNKRAAPATSEGQSKRCKP

SEQ ID NO: 865878 - protein, 122 aa, Homo sapiens
MWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLRLPISGVCEGCREPG

SEQ ID NO: 865879 - protein, 123 aa, Homo sapiens; identical to SEQ ID NO: 865872

SEQ ID NO: 865880 - protein, 172 aa, Homo sapiens
MDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAFPSCHWSASTASGSSPTTT

SEQ ID NO: 865881 - protein, 123 aa, Homo sapiens; identical to SEQ ID NO: 865872

SEQ ID NO: 865882 - protein, 123 aa, Homo sapiens; identical to SEQ ID NO: 865872

SEQ ID NO: 865883 - protein, 123 aa, Homo sapiens; identical to SEQ ID NO: 865872

SEQ ID NO: 865884 - protein, 166 aa, Homo sapiens [sequence omitted]

SEQ ID NO: 865885 - protein, 139 aa, Homo sapiens [sequence omitted]

SEQ ID NO: 865886 - protein, 202 aa, Homo sapiens
RLRLRAREAGPALGMAEPDLECEQIRLKCIRKEGFFTVPPEHRLGRCRSVKEFEKLNRIGEDRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTGGCNLGQALSLDGTW

SEQ ID NO: 865887 - protein, 132 aa, Homo sapiens
MDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLW

SEQ ID NO: 865888 - protein, 289 aa, Homo sapiens; identical to SEQ ID NO: 865877

SEQ ID NO: 865889 - protein, 270 aa, Homo sapiens
RLRLRAREAGPALGMAEPDLECEQIRLKCIRKEGFFTVPPEHRLGRCRSVKEFEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTGTEPLNCCWEPPRRPPASTCGEEIRLPLLGPQEGLGQEPGHLVPELSLRGGAGVQWGLCQPPTPREVGLSLETQEEV

SEQ ID NO: 865890 - protein, 166 aa, Homo sapiens [sequence omitted]

SEQ ID NO: 865891 - protein, 123 aa, Homo sapiens; identical to SEQ ID NO: 865872

SEQ ID NO: 865892 - protein, 123 aa, Homo sapiens; identical to SEQ ID NO: 865872

SEQ ID NO: 865893 - protein, 104 aa, Homo sapiens
MDKEKDGIPISSLREITLLLRLRHPNIVELKEVVVGNHLESIFLVMGYCEQDLASLLENMPTPFSEAQVKCIVLQVLRGLQYLHRNFIIHRWVTARQSWKHKFG

SEQ ID NO: 865894 - protein, 657 aa, Homo sapiens
MIESQEPVTFEDVAVDFTQEEWQQLNPAQKTLHRDVMLETYNHLVSVGCSGIKPDVIFKLEHGKDPWIIESELSRWIYPDRVKGLESSQQIISGELLFQREILERAPKDNSLYSVLKIWHIDNQMDRYQGNQDRVLRQVTVISRETLTDEMGSKYSAFGKMFNRCTDLAPLSQKFHKFDSCENSLKSNSDLLNYNRSYARKNPTKRFRCGRPPKYNASCSVPEKEGFIHTGMEPYGDSQCEKVLSHKQAHVQYKKFQAREKPNVCSMCGKAFIKKSQLIIHQRIHTGEKPYVCGDCRKAFSEKSHLIVHQRIHTGEKPYECTKYGRAFSRKSPFTVHQRVHTGEKPYECFECPKAFSQKSHLIIHQRVHTREKPFECSECRKAFCEMSHLFIHQITHTGKKPYECTECGKTFPRKTQLIIHQRTHTGEKPYKCGECGKTFCQQSHLIGHQRIHTGEKPYVCTDCGKAFSQKSHLTGHQRLHTGEKPYMCTECGKSFSQKSPLIIHQRIHTGEKPYQCGECGKTFSQKSLLIIHLRVHTGEKPYECTECGRAFSLKSHLILHQRGHTGEKPYECSECGKAFCGKSPLIIHQKTHPREKTPECAESGMTFFWKSQMITYQRRHTGEKPSRCSDCGKAFCQHVYFTGHQNPYRKDTLYIC

SEQ ID NO: 865895 - protein, 657 aa, Homo sapiens; identical to SEQ ID NO: 865894

SEQ ID NO: 865896 - protein, 383 aa, Homo sapiens [sequence omitted]

SEQ ID NO: 865897 - protein, 383 aa, Homo sapiens [sequence omitted]

SEQ ID NO: 865898 - protein, 364 aa, Homo sapiens
MLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 865899 - protein, 383 aa, Homo sapiens [sequence omitted]

SEQ ID NO: 865900 - protein, 245 aa, Homo sapiens
MADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 865901 - protein, 477 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 865902 - protein, 345 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGDPAPGLGSCVSTSPTA

SEQ ID NO: 865903 - protein, 642 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGDPAPGLGPVSQPLPLPRHPDPSFPQVSGQLRLYPWGSPYTAWSPGEWPSVSRSSPPPPTLPSLRLHTGLPGKAPPLCPGFFIAAEQTWGWCGCVRKERVYNMKQMEEMCLMGEGRMGRWGSWMTGYRKKGWIWCVWVMAEGERKRGDLSEAWIISVHWVAVQWLVGHACLCCPPPPLHCPLPHSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 865904 - protein, 429 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQSPKKESWVVVKETHEVLDMLFPKFLKGLQDAGWKTEKHQLEVDEWRATWLLSPEKKVL

SEQ ID NO: 865905 - protein, 477 aa, Homo sapiens; identical to SEQ ID NO: 865901

SEQ ID NO: 865906 - protein, 320 aa, Homo sapiens
FAWWPGRPLRPALPRRGLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 865907 - protein, 330 aa, Homo sapiens
AAAYSTKFAAASTGKGAKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 865908 - protein, 477 aa, Homo sapiens; identical to SEQ ID NO: 865901

SEQ ID NO: 865909 - protein, 477 aa, Homo sapiens; identical to SEQ ID NO: 865901

SEQ ID NO: 865910 - protein, 477 aa, Homo sapiens; identical to SEQ ID NO: 865901

SEQ ID NO: 865911 - protein, 179 aa, Homo sapiens [sequence omitted]

SEQ ID NO: 865912 - protein, 477 aa, Homo sapiens; identical to SEQ ID NO: 865901

SEQ ID NO: 865913 - protein, 477 aa, Homo sapiens; identical to SEQ ID NO: 865901

SEQ ID NO: 865914 - protein, 496 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAVSCPVLTPPCHHQPCLEPPALWQQNQTFLWAFKMVLCPPVRSCVLSPKGHAKDWLWEALITNPSTSSLPQAGSNKCI

SEQ ID NO: 865915 - protein, 124 aa, Homo sapiens
AAAYSTKFAAASTEPCCSSASRSSRSSLLCRRLKTRRWSWGGWEHERGGSSVPPCLALKSLAHQLVTACPTHLCPVYTPSSLVLSSPHPATISPAWSHLPFGNKTKPFCGRSRWYCAHQSDPVF

SEQ ID NO: 865916 - protein, 174 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPLLSCPHPTLPPSALPGATCPLATKPNLFVGVQDGIVPTSQILCFESQRPCQGLALGGFNHQPINIKPPPGRFK

SEQ ID NO: 865917 - protein, 194 aa, Homo sapiens
AAAYSTKFAAASTEPVLLISIQVLPFLLAMPETEDQAVELGRVGARTRWEFCPPMPGPKVSCTPARHCLPYPPLSSIHTQPRLNSCQLHPTWLPCALGINPKPLSLCLKPLALLPQLCQLSSVSRKEGLVSSPDGGPSPGQEPGARTLWPQQDRGKAALFFLRATAAGGPFGNKTKPFCGRSRWYCAHQSDPVF

SEQ ID NO: 865918 - protein, 477 aa, Homo sapiens; identical to SEQ ID NO: 865901

SEQ ID NO: 865919 - protein, 177 aa, Homo sapiens
MGGQPPQPPRPAVRAQPAPKARDAQRRQRPRRRELNRGGGTHTPQPRTTTLAARAAQKKPACGTARGHSGILAGTDTTSYTTNGPAPMEQKTRERQRPGRRPTRDAHHTTRPANANHTQPRQPHPLNREQQRRNESARARRTTGTQRVAQTAARPPPERTQTRTDDSNAQNDNGDHD

SEQ ID NO: 865920 - protein, 616 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSEWPSVSRSSPPPPTLPSLRLHTGLPGKAPPLCPGFFIAAEQTWGWCGCVRKERVYNMKQMEEMCLMGEGRMGRWGSWMTGYRKKGWIWCVWVMAEGERKRGDLSEAWIISVHWVAVQWLVGHACLCCPPPPLHCPLPHSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 865921 - protein, 434 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTDQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 865922 - protein, 477 aa, Homo sapiens; identical to SEQ ID NO: 865901

SEQ ID NO: 865923 - protein, 477 aa, Homo sapiens; identical to SEQ ID NO: 865901

SEQ ID NO: 865924 - protein, 245 aa, Homo sapiens; identical to SEQ ID NO: 865900

SEQ ID NO: 865925 - protein, 185 aa, Homo sapiens [sequence omitted]

SEQ ID NO: 865926 - protein, 477 aa, Homo sapiens; identical to SEQ ID NO: 865901

SEQ ID NO: 865927 - protein, 477 aa, Homo sapiens; identical to SEQ ID NO: 865901

SEQ ID NO: 865928 - protein, 477 aa, Homo sapiens; identical to SEQ ID NO: 865901

SEQ ID NO: 865929 - protein, 348 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSR

SEQ ID NO: 865930 - protein, 233 aa, Homo sapiens
GGAGIQKLGMADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKVAACGGTHLPKTPALVVCEFTWAL

SEQ ID NO: 865931 - protein, 221 aa, Homo sapiens
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGAVSS

SEQ ID NO: 865932 - protein, 221 aa, Homo sapiens; identical to SEQ ID NO: 865931

SEQ ID NO: 865933 - protein, 221 aa, Homo sapiens; identical to SEQ ID NO: 865931

SEQ ID NO: 865934 - protein, 221 aa, Homo sapiens; identical to SEQ ID NO: 865931

SEQ ID NO: 865935 - protein, 221 aa, Homo sapiens; identical to SEQ ID NO: 865931

SEQ ID NO: 865936 - protein, 221 aa, Homo sapiens; identical to SEQ ID NO: 865931

SEQ ID NO: 865937 - protein, 221 aa, Homo sapiens; identical to SEQ ID NO: 865931

SEQ ID NO: 865938 - protein, 221 aa, Homo sapiens; identical to SEQ ID NO: 865931

SEQ ID NO: 865939 - protein, 221 aa, Homo sapiens; identical to SEQ ID NO: 865931

SEQ ID NO: 865940 - protein, 221 aa, Homo sapiens; identical to SEQ ID NO: 865931

SEQ ID NO: 865941 - protein, 221 aa, Homo sapiens; identical to SEQ ID NO: 865931

SEQ ID NO: 865942 - protein, 150 aa, Homo sapiens [sequence omitted]

SEQ ID NO: 865943 - protein, 150 aa, Homo sapiens [sequence omitted]

SEQ ID NO: 865944 - protein, 221 aa, Homo sapiens; identical to SEQ ID NO: 865931

SEQ ID NO: 865945 - protein, 221 aa, Homo sapiens; identical to SEQ ID NO: 865931

SEQ ID NO: 865946 - protein, 221 aa, Homo sapiens; identical to SEQ ID NO: 865931

SEQ ID NO: 865947 - protein, 162 aa, Homo sapiens
MSYGRPPPDVEGMTSLKVDNLTYRTSPDTLRRVFEKYGRVGDVYIPRDRYTKESRGFAFVRFHDKRDAEDAMDAMDGPIPESEPFQVSQPISLQPLEVSVPHSFSISVDLQVQIRTKVQVQVLVGLQISFAVQVPVSVQESSPSVQEGIQIQVAIEESPQVS

SEQ ID NO: 865948 - protein, 221 aa, Homo sapiens; identical to SEQ ID NO: 865931

SEQ ID NO: 865949 - protein, 221 aa, Homo sapiens; identical to SEQ ID NO: 865931

SEQ ID NO: 865950 - protein, 221 aa, Homo sapiens; identical to SEQ ID NO: 865931

SEQ ID NO: 865951 - protein, 128 aa, Homo sapiens
GGLGGSARAGPAPLPGINPAVLARPARSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGAVSS

SEQ ID NO: 865952 - protein, 224 aa, Homo sapiens
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGASSMLLL

SEQ ID NO: 865953 - protein, 221 aa, Homo sapiens; identical to SEQ ID NO: 865931

SEQ ID NO: 865954 - protein, 221 aa, Homo sapiens; identical to SEQ ID NO: 865931

SEQ ID NO: 865955 - protein, 221 aa, Homo sapiens; identical to SEQ ID NO: 865931

SEQ ID NO: 865956 - protein, 221 aa, Homo sapiens; identical to SEQ ID NO: 865931

SEQ ID NO: 865957 - protein, 221 aa, Homo sapiens; identical to SEQ ID NO: 865931

SEQ ID NO: 865958 - protein, 221 aa, Homo sapiens; identical to SEQ ID NO: 865931

SEQ ID NO: 865959 - protein, 221 aa, Homo sapiens; identical to SEQ ID NO: 865931

SEQ ID NO: 865960 - protein, 221 aa, Homo sapiens; identical to SEQ ID NO: 865931

SEQ ID NO: 865961 - protein, 221 aa, Homo sapiens; identical to SEQ ID NO: 865931

SEQ ID NO: 865962 - protein, 221 aa, Homo sapiens; identical to SEQ ID NO: 865931

SEQ ID NO: 865963 - protein, 221 aa, Homo sapiens; identical to SEQ ID NO: 865931

SEQ ID NO: 865964 - protein, 221 aa, Homo sapiens; identical to SEQ ID NO: 865931

SEQ ID NO: 865965 - protein, 221 aa, Homo sapiens; identical to SEQ ID NO: 865931

SEQ ID NO: 865966 - protein, 98 aa, Homo sapiens
CDGGCSRSGGRVWSRRTDLEISRSKSRSRTRSRSRSTSKSRSARRSKSKSSSVSRSRSRSRSRSRSRSPPPVSKRESKSRSRSKSPPKSPEEEGAVSS

SEQ ID NO: 865967 - protein, 179 aa, Homo sapiens
MKKRWGPRWGAPPLPPAQSRSSGLPGGKSVSRAFQLPANSAPPPSSRDSALFGPPAGLCAGASGRGGARGRVVTKRGAVGQSEGFISGWRGRHFVRSDINGRRGRLPAQLLLRCASLRSPSVLFCGKAFPSCPRGNPNPGRDRRVPPSLLKRKERCPLKKMVMSGNPRHITLIHKWDLG

SEQ ID NO: 865968 - protein, 221 aa, Homo sapiens; identical to SEQ ID NO: 865931

SEQ ID NO: 865969 - protein, 121 aa, Homo sapiens
MQIRTIRPTLHSRSVSVFHESSITRARRGHPDAAVLASGESSTREVSRRDAVISRILIDRRNADRAAPSNVSWKTARPRVSSEENDVSASSVNGGLGEKGPHSPSKKSPWNKQLAIEKVIL

SEQ ID NO: 865970 - protein, 212 aa, Homo sapiens
MPAHSLVMSSPALPAFLLCSTLLVIKMYVVAIITGQVRLRKKAFANPEDALRHGGPQYCRSDPDVERCLRAHRNDMETIYPFLFLGFVYSFLGPNPFVAWMHFLVFLVGRVAHTVAYLGKLRAPIRSVTYTWPAPCASMALQILWEAAATCDQQLMPPWHQTMRQEPAVAIPGDLMFPSELGWALKSSVPWRLVCRVGLWAQWPVCVPRVVL

SEQ ID NO: 865971 - protein, 288 aa, Homo sapiens
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 865972 - protein, 288 aa, Homo sapiens; identical to SEQ ID NO: 865971

SEQ ID NO: 865973 - protein, 288 aa, Homo sapiens; identical to SEQ ID NO: 865971

SEQ ID NO: 865974 - protein, 288 aa, Homo sapiens; identical to SEQ ID NO: 865971

SEQ ID NO: 865975 - protein, 288 aa, Homo sapiens; identical to SEQ ID NO: 865971

SEQ ID NO: 865976 - protein, 288 aa, Homo sapiens; identical to SEQ ID NO: 865971

SEQ ID NO: 865977 - protein, 288 aa, Homo sapiens; identical to SEQ ID NO: 865971

SEQ ID NO: 865978 - protein, 288 aa, Homo sapiens; identical to SEQ ID NO: 865971

SEQ ID NO: 865979 - protein, 288 aa, Homo sapiens; identical to SEQ ID NO: 865971

SEQ ID NO: 865980 - protein, 288 aa, Homo sapiens; identical to SEQ ID NO: 865971

SEQ ID NO: 865981 - protein, 288 aa, Homo sapiens; identical to SEQ ID NO: 865971

SEQ ID NO: 865982 - protein, 288 aa, Homo sapiens; identical to SEQ ID NO: 865971

SEQ ID NO: 865983 - protein, 288 aa, Homo sapiens; identical to SEQ ID NO: 865971

SEQ ID NO: 865984 - protein, 288 aa, Homo sapiens; identical to SEQ ID NO: 865971

SEQ ID NO: 865985 - protein, 288 aa, Homo sapiens; identical to SEQ ID NO: 865971

SEQ ID NO: 865986 - protein, 288 aa, Homo sapiens; identical to SEQ ID NO: 865971

SEQ ID NO: 865987 - protein, 288 aa, Homo sapiens; identical to SEQ ID NO: 865971

SEQ ID NO: 865988 - protein, 288 aa, Homo sapiens; identical to SEQ ID NO: 865971

SEQ ID NO: 865989 - protein, 288 aa, Homo sapiens; identical to SEQ ID NO: 865971

SEQ ID NO: 865990 - protein, 288 aa, Homo sapiens; identical to SEQ ID NO: 865971

SEQ ID NO: 865991 - protein, 288 aa, Homo sapiens; identical to SEQ ID NO: 865971

SEQ ID NO: 865992 - protein, 271 aa, Homo sapiens
MSSRKQGSQPRGQQSAEEENFKKPTRSNIQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 865993 - protein, 288 aa, Homo sapiens; identical to SEQ ID NO: 865971

SEQ ID NO: 865994 - protein, 170 aa, Homo sapiens
MEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 865995 - protein, 288 aa, Homo sapiens; identical to SEQ ID NO: 865971

SEQ ID NO: 865996 - protein, 288 aa, Homo sapiens; identical to SEQ ID NO: 865971

SEQ ID NO: 865997 - protein, 116 aa, Homo sapiens
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPSGTGKQWVPGGQGTPNLV

SEQ ID NO: 865998 - protein, 424 aa, Homo sapiens
MRAPGCGRLVLPLLLLAAAALAEGDAKGLKEGETPGNFMEDEQWLSSISQYSGKIKHWNRFRDEVEDDYIKSWEDNQQGDEALDTTKDPCQKVKCSRHKVCIAQGYQRAMCISRKKLEHRIKQPTVKLHGNKDSICKPCHMAQLASVCGSDGHTYSSVCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 865999 - protein, 424 aa, Homo sapiens; identical to SEQ ID NO: 865998

SEQ ID NO: 866000 - protein, 366 aa, Homo sapiens
DLYDDPRPIVDLPVTLVREFIERQHAKNRYYYYHRQYRRVPDITECKEEDIMCISRKKLGHRIKQPTVKLHGNKDSICKPCHMAQLASVCGSDGHTYSSVCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 866001 - protein, 302 aa, Homo sapiens
LQPWLELPESWSQTLSVPDLGQVQVGSGAWKRHYGQCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 866002 - protein, 70 aa, Homo sapiens
SNAAVTASNAADCIQRRCLHPTPLMSKVADRSFLSSLICDLDQGACHPAPPVPSPRCLAPSCPHSPGLGR

SEQ ID NO: 866003 - protein, 137 aa, Homo sapiens
MSSAWWVHSKSICAEPSSQSLLTADGDDSTAKMTTSKKAGGARFLPGDPQRARPFSSLVWLRIQGKKCETLVYDAWLVLQGTSMRVSVELVRRRLSPGVVERLRAGGSPRGETPQKETQTSRGSSQQSKLLSSLKPA

SEQ ID NO: 866004 - protein, 92 aa, Homo sapiens
MRAPGCGRLVLPLLLLAAAALAEGDAKGLKEGETPGNFMEDEQWLSSISQYSGKIKHWNRFRDEVEVRRAAKAETRGCGFGDVSSGVCGSGR

SEQ ID NO: 866005 - protein, 230 aa, Homo sapiens
MSTGCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCGTGWAAQG

SEQ ID NO: 866006 - protein, 164 aa, Homo sapiens
ARPHLNRVPHLTALLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 866007 - protein, 142 aa, Homo sapiens
ALQLCQAGGLLPPEAEAPLSSRDPAILVGVTGVEEGTDADLFLDQTELAAINLDKYEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 866008 - protein, 424 aa, Homo sapiens; identical to SEQ ID NO: 865998

SEQ ID NO: 866009 - protein, 424 aa, Homo sapiens; identical to SEQ ID NO: 865998

SEQ ID NO: 866010 - protein, 111 aa, Homo sapiens
MRAPGCGRLVLPLLLLAAAALAEGDAKGLKEGETPGNFMEDEQWLSSISQYSGKIKHWNRFRDEVEFPRPTHPVQRRPHHDLSRFLLKLRASTSSLEICLKHTCFIGYPAK

SEQ ID NO: 866011 - protein, 111 aa, Homo sapiens
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVEVFFV

SEQ ID NO: 866012 - protein, 212 aa, Homo sapiens
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVEVYHTFHDEVDEYRRHWWRCNGPCQHRPPYYGYVKRATNREPSAHDYWWAEHQKTCGGTYIKIKEPENYSKKGKGKAKLGKEPVLAAENKDLRVYSSDFYVTIAMM

SEQ ID NO: 866013 - protein, 489 aa, Homo sapiens
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVETLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKDKPNRGEAQLVIPFSGKGYVLGETSNLPSPGKLITSHAINKTQDLLNQNHSANAVRLNSKIKVKFEQNGSSKNSHLVSPAVSNSHQNVLSNYFPRVSFANQKAFRGVNGSPRISVTVGNIPKNSVSSSSQRRVSSSKISLRNSSKVTESASVMPSQDVSGSEDTFPNKRPRLEDKTVFDNFFIKKEQIKSSGNDPKYSTTTAQNSSSSSSQSKMVNCPVCQNEVLESQINEHLDWCLEGDSIKVKSEESL

SEQ ID NO: 866014 - protein, 489 aa, Homo sapiens; identical to SEQ ID NO: 866013

SEQ ID NO: 866015 - protein, 288 aa, Homo sapiens
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVETLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKAIQDFLQSPATTCLACYSVRELGCRQHTSEGRKKKGTADNQVVRVNHHY

SEQ ID NO: 866016 - protein, 403 aa, Homo sapiens [sequence omitted]

SEQ ID NO: 866017 - protein, 92 aa, Homo sapiens
LLMYIVFLQLLTCLLNTKNSVSTQVYHTFHDEVDEYRRHWWRCNGPCQHRPPYYGYVKRATNREPSAHDYWWAEHQKTCGGTYIKIKEPENY

SEQ ID NO: 866018 - protein, 489 aa, Homo sapiens; identical to SEQ ID NO: 866013

SEQ ID NO: 866019 - protein, 489 aa, Homo sapiens; identical to SEQ ID NO: 866013

SEQ ID NO: 866020 - protein, 288 aa, Homo sapiens; identical to SEQ ID NO: 866015

SEQ ID NO: 866021 - protein, 255 aa, Homo sapiens
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVETLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKDLRVYSSDFYVTIAMM

SEQ ID NO: 866022 - protein, 142 aa, Homo sapiens
GRRGRDWTRLGREMAAAAVSSAKRSLRGELKQRLRAMSAEERLRQSRVLSQKVIAHSEYQKSKRISIFLSMQDEIETEEIIKDIFQRGKICFIPRYRFQSNHMDMVRIESPEEISLLPKTSWNIPQPGEGDVREEALSTGGT

SEQ ID NO: 866023 - protein, 172 aa, Homo sapiens
MAAETGYWRCLPESRTCAEEAVHLWPAVLRDPRWGNPGDGGLALLYAGASAGVSGVDASFLRLFPCCCESERAAGGGGSGAGMEDVNSNVNADQEGGLDLIFMPGLGFDKHGNRLGRGKGYYDAYLKRCLQHQEVKPYTLALAFKEQICLQVPVNENDMKVDEVLYEDSSTA

SEQ ID NO: 866024 - protein, 130 aa, Homo sapiens
FLFCPTLCFLDINGHTLFLEIRERIDVITKQKTHPEMIFQKQLILLNLFLFSAGGLDLIFMPGLGFDKHGNRLGRGKGYYDAYLKRCLQHQEVKPYTLALAFKEQICLQVPVNENDMKVDEVLYEDSSTA

SEQ ID NO: 866025 - protein, 105 aa, Homo sapiens
MARSRLTATSVSQVQVIAHSEYQKSKRISIFLSMQDEIETEEIIKDIFQRGKICFIPRYRFQSNHMDMVRIESPEEISLLPKTSWNIPQPGEGDVREEALSTGGT

SEQ ID NO: 866026 - protein, 156 aa, Homo sapiens
MAAAAVSSAKRSLRGELKQRLRAMSAEERLRQSRVLSQKVRGRPERKPRRTDPPKAWRPAIADLCMVIAHSEYQKSKRISIFLSMQDEIETEEIIKDIFQRGKICFIPRYRFQSNHMDMVRIESPEEISLLPKTSWNIPQPGEGDVREEALSTGGT

SEQ ID NO: 866027 - protein, 103 aa, Homo sapiens
MEDVNSNVNADQEVIAHSEYQKSKRISIFLSMQDEIETEEIIKDIFQRGKICFIPRYRFQSNHMDMVRIESPEEISLLPKTSWNIPQPGEGDVREEALSTGGT

SEQ ID NO: 866028 - protein, 142 aa, Homo sapiens; identical to SEQ ID NO: 866022

SEQ ID NO: 866029 - protein, 105 aa, Homo sapiens; identical to SEQ ID NO: 866025

SEQ ID NO: 866030 - protein, 142 aa, Homo sapiens; identical to SEQ ID NO: 866022

SEQ ID NO: 866031 - protein, 148 aa, Homo sapiens
GRRGRDWTRLGREMAAAAVSSAKRSLRGELKQRLRAMSAEERLRQSRVLSQKVIAHSEYQKSKRISIFLSMQDEIETEEIIKDIFQRGKICFIPRYRFQSNHMDMVRIESPEEISLLPGDLISSSCQALGLTNMATDWGGARATMMPI

SEQ ID NO: 866032 - protein, 112 aa, Homo sapiens
MARSRLTATSVSQVQVIAHSEYQKSKRISIFLSMQDEIETEEIIKDIFQRGKICFIPRYRFQSNHMDMVRIESPEEISLLPKTSWNIPQPGEGDVREEALSTGIEDRTELQA

SEQ ID NO: 866033 - protein, 142 aa, Homo sapiens; identical to SEQ ID NO: 866022

SEQ ID NO: 866034 - protein, 142 aa, Homo sapiens; identical to SEQ ID NO: 866022

SEQ ID NO: 866035 - protein, 156 aa, Homo sapiens; identical to SEQ ID NO: 866026

SEQ ID NO: 866036 - protein, 94 aa, Homo sapiens
ERRPWGEVRSFPWSSWKGGLDLIFMPGLGFDKHGNRLGRGKGYYDAYLKRCLQHQEVKPYTLALAFKEQICLQVPVNENDMKVDEVLYEDSSTA

SEQ ID NO: 866037 - protein, 130 aa, Homo sapiens; identical to SEQ ID NO: 866024

SEQ ID NO: 866038 - protein, 112 aa, Homo sapiens; identical to SEQ ID NO: 866032

SEQ ID NO: 866039 - protein, 149 aa, Homo sapiens
GRRGRDWTRLGREMAAAAVSSAKRSLRGELKQRLRAMSAEERLRQSRVLSQKVIAHSEYQKSKRISIFLSMQDEIETEEIIKDIFQRGKICFIPRYRFQSNHMDMVRIESPEEISLLPKTSWNIPQPGEGDVREEALSTGIEDRTELQA

SEQ ID NO: 866040 - protein, 136 aa, Homo sapiens
DLICLEPRFRPGESLCGDMKLLTHNLLSSHVRGVGSRGFPLRLQATEVRICPVEFNPNFVARMIPKVEWSAFLEAADNLRLIQVPKGPVEGYEENEEFLRTMHHLLLEVEVIEGTLQCPENLDVCSPSAAGSPTCC

SEQ ID NO: 866041 - protein, 254 aa, Homo sapiens
MRTRGGHKNTTPHRAMLHRGVTNKERRKYHNNTKHAPTEQTTTLGTRTQTESTRGDTRGGGRTHNKGGGRGAEMKGAEQQHEQPEKEEGDAAEGGKTNNIDQPGGQGRRETAARAGITHGARRRKRMKENREEEDKSEQARQRDHLHRAVRGAVLHSNRPTPRDSEGDREREEAQPTAERTRKEVRGAEVREERDKGRGGSGPRAKAGRAKQERSRRSESEVRRAEERAREAKNRETEEKTKRQGNDTGRERRE

SEQ ID NO: 866042 - protein, 105 aa, Homo sapiens
MCLFCIQRELLHCSYFAYDLHLTKNLWQKRDPTGLSPTYLSSHKHEKFQQVRHFRFSWLSNSIEWSIPGSEAAEDDLFPVPAWREVCAVDTETGYATICVDSHVP

SEQ ID NO: 866043 - protein, 133 aa, Homo sapiens
AAAYYYYYIESLCGDMKLLTHNLLSSHVRGVGSRGFPLRLQATEVRICPVEFNPNFVARMIPKVEWSAFLEAADNLRLIQVPKGPVEGYEENEEFLRTMHHLLLEVEVIEGTLQCPENLDVCSPSAAGSPTCC

SEQ ID NO: 866044 - protein, 136 aa, Homo sapiens
ADAEVTQGFPYLESLCGDMKLLTHNLLSSHVRGVGSRGFPLRLQATEVRICPVEFNPNFVARMIPKVEWSAFLEAADNLRLIQVPKGPVEGYEENEEFLRTMHHLLLEVEVIEGTLQCPENLDVCSPSAAGSPTCC

SEQ ID NO: 866045 - protein, 118 aa, Homo sapiens
MKLLTHNLLSSHVRGVGSRGFPLRLQATEVRICPVEFNPNFVARMIPKVEWSAFLEAADNLRLIQVPKGPVEGYEENEEFLRTMHHLLLEVEVIEGTLQCPENLDVCSPSAAGSPTCC

SEQ ID NO: 866046 - protein, 118 aa, Homo sapiens; identical to SEQ ID NO: 866045

SEQ ID NO: 866047 - protein, 118 aa, Homo sapiens; identical to SEQ ID NO: 866045

SEQ ID NO: 866048 - protein, 118 aa, Homo sapiens; identical to SEQ ID NO: 866045

SEQ ID NO: 866049 - protein, 106 aa, Homo sapiens
MKLLTHNLLSSHVRGVGSRGFPLRLQATEVRICPVEFNPNFVARMIPKVEWSAFLEAADNLRLIQVPKGPVEGYEENEEFLRTMHHLLLEVRSGPSLASRATCLPH

SEQ ID NO: 866050 - protein, 106 aa, Homo sapiens; identical to SEQ ID NO: 866049

SEQ ID NO: 866051 - protein, 134 aa, Homo sapiens
MKLLTHNLLSSHVRGVGSRGFPLRLQVPAGGSLPFSGGMVGRGPVLCLNSSALQATEVRICPVEFNPNFVARMIPKVEWSAFLEAADNLRLIQVPKGPVEGYEENEEFLRTMHHLLLEVRSGPSLASRATCLPH

SEQ ID NO: 866052 - protein, 128 aa, Homo sapiens
MKENREEEDKSEQARQRDHLHRAVRGAVLHSNRPTPRDSEGDREREEAQPTAERTRKEVRGAEVREERDKGRGGSGPRAKAGRAKQERSRRSESEVRRAEERAREAKNRETEEKTKRQGNDTGRERRE

SEQ ID NO: 866053 - protein, 235 aa, Homo sapiens
MKLLTHNLLSSHVRGVGSRGFPLRLQATEVRICPVEFNPNFVARMIPKVEWSAFLEAADNLRLIQVPKGPVEGYEENEEDLTHSLYMKPSMLNTTALRREPKPTLRAIPFSGYEAHFGLQLAFRIDGQHAYSTHYGKAQFPHSAQPPFTASRNTHNLRRSRQPIHQSLFIADIYPQGSVPLDNNPSALSTHAHFPDTPSSKLVNRVQLSLTFTPLASSHVRGATSPCSSLNSPSP

SEQ ID NO: 866054 - protein, 123 aa, Homo sapiens
IRSGPGMNRTRESLCGDMKLLTHNLLSSHVRGVGSRGFPLRLQATEVRICPVEFNPNFVARMIPKVEWSAFLEAADNLRLIQVPKGPVEGYEENEEFLRTMHHLLLEVRSGPSLASRATCLPH

SEQ ID NO: 866055 - protein, 118 aa, Homo sapiens; identical to SEQ ID NO: 866045

SEQ ID NO: 866056 - protein, 118 aa, Homo sapiens; identical to SEQ ID NO: 866045

SEQ ID NO: 866057 - protein, 118 aa, Homo sapiens; identical to SEQ ID NO: 866045

SEQ ID NO: 866058 - protein, 146 aa, Homo sapiens
MKLLTHNLLSSHVRGVGSRGFPLRLQVPAGGSLPFSGGMVGRGPVLCLNSSALQATEVRICPVEFNPNFVARMIPKVEWSAFLEAADNLRLIQVPKGPVEGYEENEEFLRTMHHLLLEVEVIEGTLQCPENLDVCSPSAAGSPTCC

SEQ ID NO: 866059 - protein, 128 aa, Homo sapiens; identical to SEQ ID NO: 866052

SEQ ID NO: 866060 - protein, 118 aa, Homo sapiens; identical to SEQ ID NO: 866045

SEQ ID NO: 866061 - protein, 118 aa, Homo sapiens; identical to SEQ ID NO: 866045

SEQ ID NO: 866062 - protein, 118 aa, Homo sapiens; identical to SEQ ID NO: 866045

SEQ ID NO: 866063 - protein, 118 aa, Homo sapiens; identical to SEQ ID NO: 866045

SEQ ID NO: 866064 - protein, 157 aa, Homo sapiens
MKLLTHNLLSSHVRGVGSRGFPLRLQATEVRICPVEFNPNFVARMIPKVEWSAFLEAADNVRILTPPQHIPGNAGRAHLSRAEAGVRDALEIILASCPQLRLIQVPKGPVEGYEENEEFLRTMHHLLLEVEVIEGTLQCPENLDVCSPSAAGSPTCC

SEQ ID NO: 866065 - protein, 118 aa, Homo sapiens; identical to SEQ ID NO: 866045

SEQ ID NO: 866066 - protein, 434 aa, Homo sapiens [sequence omitted]

SEQ ID NO: 866067 - protein, 69 aa, Homo sapiens
GKCRGAAGLSCPRGSAPQASWWHAGERGGGDSYPKAAELQAAVGPGVCCNPLGAARLRSLSDAETRSCW

SEQ ID NO: 866068 - protein, 802 aa, Homo sapiens
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPENLLFTDENDNLEIKIIDFGFARLKPPDNQPLKTPCFTLHYAAPELLNQNGYDESCDLWSLGVILYTMLSGQVPFQSHDRSLTCTSAVEIMKKIKKGDFSFEGEAWKNVSQEAKDLIQGLLTVDPNKRLKMSGLRYNEWLQDGSQLSSNPLMTPDILGSSGAAVHTCVKATFHAFNKYKREGFCLQNVDKAPLAKRRKMKKTSTSTETRSSSSESSHSSSSHSHGKTTPTKTLQPSNPADSNNPETLFQFSDSVA

SEQ ID NO: 866069 - protein, 802 aa, Homo sapiens; identical to SEQ ID NO: 866068

SEQ ID NO: 866070 - protein, 549 aa, Homo sapiens
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPEV

SEQ ID NO: 866071 - protein, 802 aa, Homo sapiens; identical to SEQ ID NO: 866068

SEQ ID NO: 866072 - protein, 370 aa, Homo sapiens
MGLWALLPGWVSATLLLALAALPAALAANSSGRWWGIVNVASSTNLLTDSKSLQLVLEPSLQLLSRKQRRLIRQNPGILHSVSGGLQSAVRECKWQFRNRRWNCPTAPGPHLFGKIVNRGCRETAFIFAITSAGVTHSVARSCSEGSIESCTCDYRRRGPGGPDWHWGGCSDNIDFGRLFGREFVDSGEKGRDLRFLMNLHNNEAGRTTVFSEMRQECKCHGMSGSCTVRTCWMRLPTLRAVGDVLRDRFDGASRVLYGNRGSNRASRAELLRLEPEDPAHKPPSPHDLVYFEKSPNFCTYSGRLGTAGTAGRACNSSSPALDGCELLCCGRGHRTRTQRVTERCNCTFHWCCHVSCRNCTHTRVLHECL

SEQ ID NO: 866073 - protein, 226 aa, Homo sapiens
MAAGAALALALWLLMPPVEVGGAGPPPIQDGEFTFLLPAGRKQCFYQSAPANASLETEYQVIGGAGLDVDFTLESPQGVLLVSESRKADGVHTVEPTEAGDYKLCFDNSFSTISEKLVFFELIFDSLQDDEEVEGWAEAVEPEEMLDVKMEDIKESIETMRTRLERSIQMLTLLRAFEARDRNLQEGNLERVNFWSAVNVAVLLLVAVLQVCTLKRFFQDKRPVPT

SEQ ID NO: 866074 - protein, 226 aa, Homo sapiens; identical to SEQ ID NO: 866073

SEQ ID NO: 866075 - protein, 212 aa, Homo sapiens [sequence omitted]

SEQ ID NO: 866076 - protein, 218 aa, Homo sapiens
MAAGAALALALWLLMPPVEVGGAGPPPIQDGEFTFLLPAGRKQCFYQSAPANASLETEYQVIGGAGLDVDFTLESPQGVLLVSESRKADGVHTVEPTEAGDYKLCFDNSFSTISEKLVFFELIFDSLQDDEEVEGWAEAVEPEEMLDVKMEDIKESIETMRTRLERSIQMLTLLRAFEARDRNLQEGNLERVNFWSAVNVAVLLLVAVLQRAGNTSGL

SEQ ID NO: 866077 - protein, 226 aa, Homo sapiens; identical to SEQ ID NO: 866073

SEQ ID NO: 866078 - protein, 226 aa, Homo sapiens; identical to SEQ ID NO: 866073

SEQ ID NO: 866079 - protein, 264 aa, Homo sapiens
MAAGAALALALWLLMPPVEVGGAGPPPIQDGEFTFLLPAGRKQCFYQSAPANASLETEYQVIGGAGLDVDFTLESPQGVLLVSESRKADGVHTVEPTEAGDYKLCFDNSFSTISEKLVFFELIFDSLQDDEEVEGWAEAVEPEEMLDVKMEDIKVCPGCAGATPSRSLGFTWGAPLGLTQPPLRSCALQLNYESIETMRTRLERSIQMLTLLRAFEARDRNLQEGNLERVNFWSAVNVAVLLLVAVLQVCTLKRFFQDKRPVPT

SEQ ID NO: 866080 - protein, 627 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIIKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 866081 - protein, 259 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESEPYPNGLCSKQVLEHFLWI

SEQ ID NO: 866082 - protein, 195 aa, Homo sapiens
MPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 866083 - protein, 627 aa, Homo sapiens; identical to SEQ ID NO: 866080

SEQ ID NO: 866084 - protein, 685 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIIKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVS

SEQ ID NO: 866085 - protein, 435 aa, Homo sapiens
ERSRGSPDAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIIKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 866086 - protein, 88 aa, Homo sapiens
GSGTGGGDAALDFKLAAAVLRTGGGGGASGSDEDEVSEVRLRDPRLPHIVRREFSLGRLWAGAILPLPWWSPSVTAVGSMAAVAAVRA

SEQ ID NO: 866087 - protein, 614 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIIKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 866088 - protein, 220 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRRRAEAGAEGEGKA

SEQ ID NO: 866089 - protein, 638 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSECASGSDEEKCPVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIIKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 866090 - protein, 371 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIIKVLLNEGANIEDHNENGHTPLMEAASAGHVEVARVLLDHGAGISRCRTGY

SEQ ID NO: 866091 - protein, 195 aa, Homo sapiens; identical to SEQ ID NO: 866082

SEQ ID NO: 866092 - protein, 357 aa, Homo sapiens
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLAQVLGQPHKKSL

SEQ ID NO: 866093 - protein, 156 aa, Homo sapiens
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRHLPPKKS

SEQ ID NO: 866094 - protein, 357 aa, Homo sapiens; identical to SEQ ID NO: 866092

SEQ ID NO: 866095 - protein, 106 aa, Homo sapiens
FDTSLDEILELKSSRRGRPRPKTKGKPCPERPSWRSQGTHVGLATGSDPGSMTRLAGEWGTVRTAEQISRRHRTSMLTRLLALLLVGLSCSCGPLCLAKMVKPRLY

SEQ ID NO: 866096 - protein, 153 aa, Homo sapiens
MLSSSESVKENPNPKHEGVGIERPLARPRRPLIGGDWTQRRKFSLSHMIGWEKQKLRPTAAQIGARPGRSPSLVIGGAQQTPLGCSMIGRGLLVLGPGPEPRCPIDGPEGSRRGPAQLPLVDFDLAGLGQHVDDVGLEVRVVHASLPELARVP

SEQ ID NO: 866097 - protein, 117 aa, Homo sapiens
NVSLEADLYLEKNINNLKPDMESLCLFIFKLAISLLYIARLGNVCSLTLYLLAELVSQFHVVVSSQAGLPASHNRVPFTLNAADLWYSTAGTLGTDSGLTANVWHGRSRVGTYRVWA

SEQ ID NO: 866098 - protein, 69 aa, Homo sapiens
LRVTQRIPEVTFGRDGQIPGERGSRGPFEEAGGARANWRRASCVGRRQRKHKEEAQERGPREWRPLSRP

SEQ ID NO: 866099 - protein, 148 aa, Homo sapiens
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLTYTFSGLTLSPKPWIPVLERIRDHVSGV

SEQ ID NO: 866100 - protein, 157 aa, Homo sapiens
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGIKMAVTTSGSTEMMKENWPLGAPLPLSPSVPAETLSSGIRIPVGKAPPGGWRWSGCRWPTGAY

SEQ ID NO: 866101 - protein, 157 aa, Homo sapiens; identical to SEQ ID NO: 866100

SEQ ID NO: 866102 - protein, 157 aa, Homo sapiens; identical to SEQ ID NO: 866100

SEQ ID NO: 866103 - protein, 157 aa, Homo sapiens; identical to SEQ ID NO: 866100

SEQ ID NO: 866104 - protein, 274 aa, Homo sapiens
MKKKTRRRSTRSEELTRSEELTLSEEATWSEEATQSEEATQGEEMNRSQEVTRDEESTRSEEVTREEMAAAGLTVTVTHSNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQGFLPKDLQAEALCKLDRRVKATIEQFMKILEEIDTLILPENFKDSRLKRKGLVKKVQAFLAECDTVEQNICQETERLQSTNFALAE

SEQ ID NO: 866105 - protein, 274 aa, Homo sapiens; identical to SEQ ID NO: 866104

SEQ ID NO: 866106 - protein, 241 aa, Homo sapiens
MKKKTRRRSTRSEELTRSEELTLSEEATWSEEATQSEEATQGEEMNRSQEVTRDEESTRSEEVTREEMAAAGLTVTVTHSNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQGFLPKDLQAEALCKLDRRVKATIEQFMKILEEIDTLNWPFANFPTLTLVLNEK

SEQ ID NO: 866107 - protein, 202 aa, Homo sapiens
MKKKTRRRSTRSEELTRSEELTLSEEATWSEEATQSEEATQGEEMNRSQEVTRDEESTRSEEVTREEMAAAGLTVTVTHSNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQRWGFTMLARLVSNS

SEQ ID NO: 866108 - protein, 69 aa, Homo sapiens
DEDAVFADEEGRFREIDTLILPENFKDSRLKRKGLVKKVQAFLAECDTVEQNICQETERLQSTNFALAE

SEQ ID NO: 866109 - protein, 274 aa, Homo sapiens; identical to SEQ ID NO: 866104

SEQ ID NO: 866110 - protein, 274 aa, Homo sapiens; identical to SEQ ID NO: 866104

SEQ ID NO: 866111 - protein, 251 aa, Homo sapiens
MKKKTRRRSTRSEELTRSEELTLSEEATWSEEATQSEEATQGEEMNRSQEVTRDEESTRSEEVTREEMAAAGLTVTVTHSNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQGFLPKDLQAEALCKLDRRVKATIEQFMKILEEIDTLILPENFKDSRLKRKGLVKKVQDQRRQA

SEQ ID NO: 866112 - protein, 168 aa, Homo sapiens
MKKKTRRRSTRSEELTRSEELTLSEEATWSEEATQSEEATQGEEMNRSQEVTRDEESTRSEEVTREEMAAAGLTVTVTHSNEKHDLHVTSQQGSSEPVVQDLAQVVEEVIGVPQSFQKLIFKVLQQIFIEDLLGIGHSQTPGQVSDLKSYDDGRNLTIFDEAHGQSSL

SEQ ID NO: 866113 - protein, 583 aa, Homo sapiens
MAARRRRSTGGGRARALNESKRVNNGNTAPEDSSPAKKTRRCQRQESKKMPVAGGKANKDRTEDKQDGMPGRSWASKRVSESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 866114 - protein, 570 aa, Homo sapiens
MAARRRRSTGGGRARALNESKRVNNGNTAPEDSSPAKKTRRCQRQESKKMPVAGGKANKDRTEDKQDESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 866115 - protein, 185 aa, Homo sapiens
MTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 866116 - protein, 622 aa, Homo sapiens
MAARRRRSTGGGRARALNESKRVNNGNTAPEDSSPAKKTRRCQRQESKKMPVAGGKANKDRTEDKQDESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRSESSFAFGKTLLARKYSCRTYKRESEEGVGFFMLMAYLCRTTEYNNIGFSFRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 866117 - protein, 293 aa, Homo sapiens
MAARRRRSTGGGRARALNESKRVNNGNTAPEDSSPAKKTRRCQRQESKKMPVAGGKANKDRTEDKQDGMPGRSWASKRVSESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGQLKEQTKNRVLEGNYRYYQGIFQSE

SEQ ID NO: 866118 - protein, 48 aa, Homo sapiens
MSNWVGILSHGLRIAPPEAPITGYMVSEIELWEEHRGKGYSNVLSAFF

SEQ ID NO: 866119 - protein, 531 aa, Homo sapiens
MAARRRRSTGGGRARALNESKRVNNGNTAPEDSSPAKKTRRCQRQESKKMPVAGGKANKDRTEDKQDGMPGRSWASKRVSESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTL

SEQ ID NO: 866120 - protein, 285 aa, Homo sapiens
MEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 866121 - protein, 485 aa, Homo sapiens
MAARRRRSTGGGRARALNESKRVNNGNTAPEDSSPAKKTRRCQRQESKKMPVAGGKANKDRTEDKQDESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVRQEYVCDL

SEQ ID NO: 866122 - protein, 177 aa, Homo sapiens
MAARRRRSTGGGRARALNESKRVNNGNTAPEDSSPAKKTRRCQRQESKKMPVAGGKANKDRTEDKQDESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKEPKMECCELTH

SEQ ID NO: 866123 - protein, 114 aa, Homo sapiens
STSAFLSYFSQVISQYLQSTHAPTHSDYTMTLLDLFEVEKDGEKEAFREDLHNRSESSFAFGKTLLARKYSCRTYKRESEEGVGFFMLMAYLCRTTEYNNIGFSLGCFYGMVPG

SEQ ID NO: 866124 - protein, 159 aa, Homo sapiens [sequence omitted]

SEQ ID NO: 866125 - protein, 305 aa, Homo sapiens
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCILLYSKMQEPGAVLDVVGAWLQDPANQNLPEYGALAEFHVQRVLLPLGCLSEAEELVVGSAAFGEERRLDVLQAIHTARQQQKQEHSGSEEAQKPNLEGSVSHKFLSLPMLVRQLWDSAVSHFFSLPFKKSLLAALILCLLVVRFDPASPSSLHFLYKLAQLFRWIRKAAFSRLYQLRIRD

SEQ ID NO: 866126 - protein, 305 aa, Homo sapiens; identical to SEQ ID NO: 866125

SEQ ID NO: 866127 - protein, 256 aa, Homo sapiens
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCILLYSKMQEPGAVLDVVGAWLQDPANQNLPEYGALAEFHVQRVLLPLGCLSEAEELVVGSAAFGEERRLDVLQAIHTARQQQKQEHSGSEEAQKPNLEASPSSLHFLYKLAQLFRWIRKAAFSRLYQLRIRD

SEQ ID NO: 866128 - protein, 305 aa, Homo sapiens; identical to SEQ ID NO: 866125

SEQ ID NO: 866129 - protein, 256 aa, Homo sapiens; identical to SEQ ID NO: 866127

SEQ ID NO: 866130 - protein, 125 aa, Homo sapiens
MANSGYPGASGEAVTPTSEDLGLGPGLVMKSDSSTSAAPLRGLGGPLRSSEPVRAVPARAPAVDLLEEAADLLVVHLDFRAALETCERAWQSLANHAVAEEPAGTSLEVKCSLTGVSHRARPTFL

SEQ ID NO: 866131 - protein, 217 aa, Homo sapiens
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCILLYSKMQEPGAVLDVVGAWLQDPANQNLPEYGALAEFHVQRVLLPLGCLSEAEELVVGSAAFGEERRLDVLQAIHTARQQQKQEHSGSEEAP

SEQ ID NO: 866132 - protein, 305 aa, Homo sapiens; identical to SEQ ID NO: 866125

SEQ ID NO: 866133 - protein, 305 aa, Homo sapiens; identical to SEQ ID NO: 866125

SEQ ID NO: 866134 - protein, 305 aa, Homo sapiens; identical to SEQ ID NO: 866125

SEQ ID NO: 866135 - protein, 305 aa, Homo sapiens; identical to SEQ ID NO: 866125

SEQ ID NO: 866136 - protein, 305 aa, Homo sapiens; identical to SEQ ID NO: 866125

SEQ ID NO: 866137 - protein, 305 aa, Homo sapiens; identical to SEQ ID NO: 866125

SEQ ID NO: 866138 - protein, 305 aa, Homo sapiens; identical to SEQ ID NO: 866125

SEQ ID NO: 866139 - protein, 305 aa, Homo sapiens; identical to SEQ ID NO: 866125

SEQ ID NO: 866140 - protein, 489 aa, Homo sapiens
MNKLSPVLLFLNQQNYQIDKDVEDKRQKAIEEFFTKDVIVPSPWTDHEGKQLSQCHSSKCTNINSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDHTTQRCWMKTASPFQCSSP

SEQ ID NO: 866141 - protein, 576 aa, Homo sapiens
SLCLSWKLAWPPELPGVGTGGFVLYAPFSLCAMGDVKESKMQITPETPGRIPVLNPFESPSDYSNLHEQTLASPSVFKSTKLPTPGKFRWSIDQLAVINPVEIDPEDIHRQALYLSHSRFSLKMSSYPLLGLIMKGNSFHNVIPVNALTSNSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDHTTQRCWMKTASPFQCSSP

SEQ ID NO: 866142 - protein, 591 aa, Homo sapiens
SLCLSWKLAWPPELPGVGTGGFVLYAPFSLCAMGDVKESKMQITPETPGRIPVLNPFESPSDYSNLHEQTLASPSVFKSTKLPTPGKFRWSIDQLAVINPVEIDPEDIHRQALYLSHSRIDKDVEDKRQKAIEEFFTKDVIVPSPWTDHEGKQLSQCHSSKCTNINSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDHTTQRCWMKTASPFQCSSP

SEQ ID NO: 866143 - protein, 617 aa, Homo sapiens
SLCLSWKLAWPPELPGVGTGGFVLYAPFSLCAMGDVKESKMQITPETPGRIPVLNPFESPSDYSNLHEQTLASPSVFKSTKLPTPGKFRWSIDQLAVINPVEIDPEDIHRQALYLSHSRIDKDVEDKRQKAIEEFFTKDVIVPSPWTDHEGKQLSQCHSSKCTNINSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDTTQHCGETQPFMASIKPGRIKLAKSHMWPAHWGGKTRRVPMKRVA

SEQ ID NO: 866144 - protein, 591 aa, Homo sapiens; identical to SEQ ID NO: 866142

SEQ ID NO: 866145 - protein, 591 aa, Homo sapiens; identical to SEQ ID NO: 866142

SEQ ID NO: 866146 - protein, 334 aa, Homo sapiens
MFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDHTTQRCWMKTASPFQCSSP

SEQ ID NO: 866147 - protein, 410 aa, Homo sapiens
MLVEKEWLSFGHKFSQRSSLTLNCQGSGFAPVFLQFLDCVHQVHNQYPTEFEFNLYYLKFLAFHYVSNRFKTFLLDSDYERLEHGTLFDDKGEKHAKKGVCIWECIDRMHKRSPIFFNYLYSPLEIEALKPNVNVSSLKKWDYYIEETLSTGPSYDWMMLTPKHFPSEDSDLAGEAGPRSQRRTVWPCYDDVSCTQPDALTSLFSEIEKLEHKLNQAPEKWQQLWERVTVDLKEEPRTDRSQRHLSRSPGIVSTNLPSYQKRSLLHLPDSSMGEEQNSSISPSNGVERRAATLYSQYTSKNDENRSFEGTLYKRGALLKGWKPRWFVLDVTKHQLRYYDSGEDTSCKGHIDLAEVEMVIPAGPSMGAPKHTSDKAFFDLKTSKRVYNFCAQDGQSAQQWMDKIQSCISDA

SEQ ID NO: 866148 - protein, 618 aa, Homo sapiens
MTSKTVAPEHAPFSLVSGIPTLDYLTPRLWLCEGVWASLRSSTRLISSPTSFIDVGARLAGKDHSASFSNSSYLQNQLLKRQAALYIFGEKSQLRNFKVEFALNCEFVPVEFHEIRQVKASFKKLMRACIPSTIPTDSEVTFLKALGDSEWFPQLHRIMQLAVVVSEVLENGSSVLVCLEEGWDITAQVTSLVQLLSDPFYRTLEGFQMLVEKEWLSFGHKFSQRSSLTLNCQGSGFAPVFLQFLDCVHQVHNQYPTEFEFNLYYLKFLAFHYVSNRFKTFLLDSDYERLEHGTLFDDKGEKHAKKGVCIWECIDRMHKRSPIFFNYLYSPLEIEALKPNVNVSSLKKWDYYIEETLSTGPSYDWMMLTPKHFPSEDSDLAGEAGPRSQRRTVWPCYDDVSCTQPDALTSLFSEIEKLEHKLNQAPEKWQQLWERVTVDLKEEPRTDRSQRHLSRSPGIVSTNLPSYQKRSLLHLPDSSMGEEQNSSISPSNGVERRAATLYSQYTSKNDENRSFEGTLYKRGALLKGWKPRWFVLDVTKHQLRYYDSGEDTSCKGHIDLAEVEMVIPAGPSMGAPKHTSDKAFFDLKTSKRVYNFCAQDGQSAQQWMDKIQSCISDA

SEQ ID NO: 866149 - protein, 618 aa, Homo sapiens; identical to SEQ ID NO: 866148

SEQ ID NO: 866150 - protein, 67 aa, Homo sapiens
ITLDGALDFVICSDFVKSTITLDGGVLVHVQKWDGKSTTIKRKREDDKLVVECVMKGVTSTRVYERA

SEQ ID NO: 866151 - protein, 132 aa, Homo sapiens
MCDAFVGTWKLVSSENFDDYMKEVGVGFATRKVAGMAKPNMIISVNGDVITIKSESTFKNTEISFILGQEFDEVTADDRKVKSTITLDGGVLVHVQKWDGKSTTIKRKREDDKLVVECVMKGVTSTRVYERA

SEQ ID NO: 866152 - protein, 132 aa, Homo sapiens; identical to SEQ ID NO: 866151

SEQ ID NO: 866153 - protein, 132 aa, Homo sapiens; identical to SEQ ID NO: 866151

SEQ ID NO: 866154 - protein, 132 aa, Homo sapiens; identical to SEQ ID NO: 866151

SEQ ID NO: 866155 - protein, 132 aa, Homo sapiens; identical to SEQ ID NO: 866151

SEQ ID NO: 866156 - protein, 132 aa, Homo sapiens; identical to SEQ ID NO: 866151

SEQ ID NO: 866157 - protein, 83 aa, Homo sapiens
LTIKDKFLNATFAFPSSRFTSLIPAEVQVFLASSSLRLRIKSLGEKGTASTTASQSLWQTYHSTGKLALARISGYYYRVGKKV

SEQ ID NO: 866158 - protein, 315 aa, Homo sapiens
MAFPEPKPRPPELPQKRLKTLDCGQGAVRAVRFNVDGNYCLTCGSDKTLKLWNPLRGTLLRTYSGHGYEVLDAAGSFDNSSLCSGGGDKAVVLWDVASGQVVRKFRGHAGKVNTVQFNEEATVILSGSIDSSIRCWDCRSRRPEPVQTLDEARDGVSSVKVSDHEILAGSVDGRVRRYDLRMGQLFSDYVGSPITCTCFSRDGQCTLVSSLDSTLRLLDKDTGELLGEYKGHKNQEYKLDCCLSERDTHVVSCSEDGKVFFWDLVEGALALALPVGSGVVQSLAYHPTEPCLLTAMGGSVQCWREEAYEAEDGAG

SEQ ID NO: 866159 - protein, 169 aa, Homo sapiens
MAFPEPKPRPPELPQKRLKTLDCGQGAVRAVRFNVDGNYCLTCGSDKTLKLWNPLRGTLLRTYSGHGYEVLDAAGSFDNSSLCSGGGDKAVVLWDVASGQVVRKFRGHAGKVNTVQFNEEATVILSGSIDSSIRCWDCRSRRPEPVQTLDEARDGVSSVKVSDHEILAG

SEQ ID NO: 866160 - protein, 344 aa, Homo sapiens [sequence omitted]

SEQ ID NO: 866161 - protein, 169 aa, Homo sapiens; identical to SEQ ID NO: 866159

SEQ ID NO: 866162 - protein, 185 aa, Homo sapiens [sequence omitted]

SEQ ID NO: 866163 - protein, 256 aa, Homo sapiens
MAFPEPKPRPPELPQKRLKTLDCGQGAVRAVRFNVDGNYCLTCGSDKTLKLWNPLRGTLLRTYSGHGYEVLDAAGSFDNSSLCSGGGDKAVVLWDVASGQVVRKFRGHAGKVNTVQFNEEATVILSGSIDSSIRCWDCRSRRPEPVQTLDEARDGVSSVKVSDHEILAGSVDGRVRRYDLRMGQLFSDYVGSPITCTCFSRDGQCTLVSSLDSTLRLLDKDTGELLGEYKGHKNQEYKTEVREGEEKNREDREIRR

SEQ ID NO: 866164 - protein, 343 aa, Homo sapiens
MAFPEPKPRPPELPQKRLKTLDCGQGAVRAVRFNGERLRLHSGSSSRLLEIDGPVTPAWCSPVDGNYCLTCGSDKTLKLWNPLRGTLLRTYSGHGYEVLDAAGSFDNSSLCSGGGDKAVVLWDVASGQVVRKFRGHAGKVNTVQFNEEATVILSGSIDSSIRCWDCRSRRPEPVQTLDEARDGVSSVKVSDHEILAGSVDGRVRRYDLRMGQLFSDYVGSPITCTCFSRDGQCTLVSSLDSTLRLLDKDTGELLGEYKGHKNQEYKLDCCLSERDTHVVSCSEDGKVFFWDLVEGALALALPVGSGVVQSLAYHPTEPCLLTAMGGSVQCWREEAYEAEDGAG

SEQ ID NO: 866165 - protein, 169 aa, Homo sapiens; identical to SEQ ID NO: 866159

SEQ ID NO: 866166 - protein, 33 aa, Homo sapiens
MGPYWEIGSLLTILSYDEAVLCGGPYPRRQLPH

SEQ ID NO: 866167 - protein, 84 aa, Homo sapiens
GCALFRITTASHVLLEGRTERVLAGLDPTGVRRRQRRIPEKRLGLRKALRERLAGQFGRLHRSRVPGGTCRPEGGVWGRCREDG

SEQ ID NO: 866168 - protein, 196 aa, Homo sapiens [sequence omitted]

SEQ ID NO: 866169 - protein, 240 aa, Homo sapiens
GCALFRITTASHVLLEGRTERVLAGLDPTGVRRRQRRIPEKRLGLRKALRERLAGQFGRLHRSRVPGGTCRPEGGGPTAELSPPGSGKDPTEAKAAPEGQVRVPFLEEAGARKAVTLALATGFPGAVLSQELHSAGHLQKTVFRVYFLLSSTQSPTAANARGQKMFGGRKTKAGSGGGLTVRVCLQRREGAGSVSSCFSKLQGPGSPLQGRAPLLPARHWRWPPERRRPTPAPGLSGGNG

SEQ ID NO: 866170 - protein, 107 aa, Homo sapiens
MQTDTSNLSARSCRFCVMSPLRTLLRSSEMRRKLLAVSASKVISTVKRKTSCSASGQKPTPCLSSTSKAQISPDFSFFNSVSSSKIKTFHEETSLFQIFIGMLCGNT

SEQ ID NO: 866171 - protein, 107 aa, Homo sapiens; identical to SEQ ID NO: 866170

SEQ ID NO: 866172 - protein, 107 aa, Homo sapiens; identical to SEQ ID NO: 866170

SEQ ID NO: 866173 - protein, 722 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 866174 - protein, 167 aa, Homo sapiens
MGVPSLREEEKPFYHQKAVPSGALQPRRRMWTARSIPALTATLRCVRDPQRSFALGIQWIVVRILGGIPGPIAFGWVIDKACLLWQDQCGQQGSCLVYQNSAMSRYILIMGLLYKAPLLRIHPTLDGKCSFCGRWNWRVRRADCTYKYTYMSVHMFLYKRVTVKLFL

SEQ ID NO: 866175 - protein, 700 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKFQLPEVHHSLNVLNRKFQKQTVHNL

SEQ ID NO: 866176 - protein, 620 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVSGAAAYRPCPPLDPGKGPPCLPLVIGAIVGLPRCTETVAVSLRIFPLVLAMPLQGNALQLVRESPSFWFSYSL

SEQ ID NO: 866177 - protein, 684 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKEEENEFRRL

SEQ ID NO: 866178 - protein, 493 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPPTKRRPTKHSKKKKKNKNTKKNKKKKPESEHKARGSRDKSGVIRHGATDGAKTRVPRDPRVFWEHRGENPARGATPPNKGERRDRNKLSRKKAPRGVYTGATYKETPAEQDWTSTQTHRDTTQRDTDPKPHTERDRRTQTQITTTQRAGARQGDQQETKTEQGNATEPGPGSKANRDKHKVDGTRKDKTRRKTGRKETGEKEEETAQEGKEERERGSKRGHRRKRTGEDTSGVGRQQAGNGDTDEARRKK

SEQ ID NO: 866179 - protein, 86 aa, Homo sapiens
LFSTPPPLPSSIWLLLKNPTFILLCLAGATEATLITGMSTFSPKFLESQFSLSASEAATLFGEKTESWGSSAFMSVLRNRVFKGIF

SEQ ID NO: 866180 - protein, 620 aa, Homo sapiens; identical to SEQ ID NO: 866176

SEQ ID NO: 866181 - protein, 722 aa, Homo sapiens; identical to SEQ ID NO: 866173

SEQ ID NO: 866182 - protein, 549 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKMCP

SEQ ID NO: 866183 - protein, 240 aa, Homo sapiens
MGTSPMADPVPAGRQHGSGLDPTTRLSPLCSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKFQLPEVHHSLNVLNRKFQKQTVHNL

SEQ ID NO: 866184 - protein, 463 aa, Homo sapiens
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALNPKVNLFAELTPEEIDELGYTLYCSLSEPEVLLQT

SEQ ID NO: 866185 - protein, 463 aa, Homo sapiens; identical to SEQ ID NO: 866184

SEQ ID NO: 866186 - protein, 463 aa, Homo sapiens; identical to SEQ ID NO: 866184

SEQ ID NO: 866187 - protein, 463 aa, Homo sapiens; identical to SEQ ID NO: 866184

SEQ ID NO: 866188 - protein, 285 aa, Homo sapiens
MPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALNPKVNLFAELTPEEIDELGYTLYCSLSEPEVLLQT

SEQ ID NO: 866189 - protein, 285 aa, Homo sapiens; identical to SEQ ID NO: 866188

SEQ ID NO: 866190 - protein, 328 aa, Homo sapiens
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPDPKVNLFAELTPEEIDELGYTLYCSLSEPEVLLQT

SEQ ID NO: 866191 - protein, 105 aa, Homo sapiens [sequence omitted]

SEQ ID NO: 866192 - protein, 437 aa, Homo sapiens
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALRQGLEGTQP

SEQ ID NO: 866193 - protein, 1035 aa, Homo sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPEEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 866194 - protein, 738 aa, Homo sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPEEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKVRDTDGTLPQQQAPSPSTSH

SEQ ID NO: 866195 - protein, 442 aa, Homo sapiens
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHLAQENRVVAFFSLALLLAPLVETLILLDRLLYLQEQAFPRFPC

SEQ ID NO: 866196 - protein, 477 aa, Homo sapiens
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVGQPFLRPGLQEQGLLGWNGAQRLDYIFQVSQLELVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHLAQENRVVAFFSLALLLAPLVETLILLDRLLYLQEQAFPRFPC

SEQ ID NO: 866197 - protein, 295 aa, Homo sapiens
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRYVQRGLQRVGLDPQLPLNLAALQAHLAQENRVVAFFSLALLLAPLVETLILLDRLLYLQEQAFPRFPC

SEQ ID NO: 866198 - protein, 497 aa, Homo sapiens
MPGISARGLSHEGRKQLAVNLTRVLALYRSILDAYIIEFFTDNLWDTLPCSWQEALDGLKPPQLATMLLGMPGEGEVVRYGLEGPCAGELKALSPAVSILLRESHKVFLGLGLQTAALRCDGTIHWRPRLDYLRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHLAQENRVVAFFSLALLLAPLVETLILLDRLLYLQEQAFPRFPC

SEQ ID NO: 866199 - protein, 403 aa, Homo sapiens
MPTSSYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVGQPFLRPGLQEQGLLGWNGAQRLDYIFQVSQLELVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHLAQENRVVAFFSLALLLAPLVETLILLDRLLYLQEQAFPRFPC

SEQ ID NO: 866200 - protein, 376 aa, Homo sapiens
MLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHLAQENRVVAFFSLALLLAPLVETLILLDRLLYLQEQAFPRFPC

SEQ ID NO: 866201 - protein, 340 aa, Homo sapiens
MPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHLAQENRVVAFFSLALLLAPLVETLILLDRLLYLQEQAFPRFPC

SEQ ID NO: 866202 - protein, 442 aa, Homo sapiens; identical to SEQ ID NO: 866195

SEQ ID NO: 866203 - protein, 442 aa, Homo sapiens; identical to SEQ ID NO: 866195

SEQ ID NO: 866204 - protein, 361 aa, Homo sapiens
ANLTRVRARCCSQASTPVGDLSVALRHFSCCPEVVALAQLGCCYMKLSDPGGYPLSQWVAGLPGYELPYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQICAAGATASGARSPAATESGCPSGPPGPGEPCGGLLQPGSTACPTGGDAYSTGPAAVPSGTGFSQVSMLSSCPSSVLNSLPETWFWWPPRCPWVRLFLFWRLKTADAA

SEQ ID NO: 866205 - protein, 421 aa, Homo sapiens
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGEGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHLAQENRVVAFFSLALLLAPLVETLILLDRLLYLQEQAFPRFPC

SEQ ID NO: 866206 - protein, 320 aa, Homo sapiens
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQICAAGATASGARSPAATESGCPSGPPGPGEPCGGLLQPGSTACPTGGDAYSTGPAAVPSGTGFSQVSMLSSCPSSVLNSLPETWFWWPPRCPWVRLFLFWRLKTADAA

SEQ ID NO: 866207 - protein, 483 aa, Homo sapiens
ANLTRVRARCCSQASTPVGDLSVALRHFSCCPEVVALAQLGCCYMKLSDPGGYPLSQWVAGLPGYELPYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHLAQENRVVAFFSLALLLAPLVETLILLDRLLYLQEQAFPRFPC

SEQ ID NO: 866208 - protein, 409 aa, Homo sapiens
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLLQPGSTACPTGGDAYSTGPAAVPSGTGFSQVSMLSSCPSSVLNSLPETWFWWPPRCPWVRLFLFWRLKTADAA

SEQ ID NO: 866209 - protein, 260 aa, Homo sapiens
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRYVQRGLQRVGLDPQLPLNLAALQALSVLETEDS

SEQ ID NO: 866210 - protein, 168 aa, Homo sapiens
MSLTHRLHLCKYWGCAVSNVCRFWEGRPLPLMIVVPYTLPVSLPVGSCVIITGTPILTFVKDPQLEVNFYTGMDEDSDIAFQFRLHFGHPAIMNSCVFGIWRYEEKCYYLPFEDGKPFELCIYVRHKEYKVMVNGQRIYNFAHRFPPASVKMLQVFRDISLTRVLISD

SEQ ID NO: 866211 - protein, 102 aa, Homo sapiens
VCVCTMGGPAQHAVCFDLSKDPQLEVNFYTGMDEDSDIAFQFRLHFGHPAIMNSCVFGIWRYEEKCYYLPFEDGKPFELCIYVRHKEYKVSTSGSSSAGALW

SEQ ID NO: 866212 - protein, 139 aa, Homo sapiens
MSSLPVPYTLPVSLPVGSCVIITGTPILTFVKDPQLEVNFYTGMDEDSDIAFQFRLHFGHPAIMNSCVFGIWRYEEKCYYLPFEDGKPFELCIYVRHKEYKVMVNGQRIYNFAHRFPPASVKMLQVFRDISLTRVLISD

SEQ ID NO: 866213 - protein, 151 aa, Homo sapiens
MRVPRHPGGSHRSAVGLLCEKGPAAPSLVQIRCQTVFLGIHPNRSLISLCGSPGPPSRPEPKCLGSRERPVPFFSSLATSSHFRLLTVPKQPPKTLRELGPGPEAENGRKKRSGRRWVSLCHPDWSAVSGAIIAYCSLKLLGSSDLLASAS

SEQ ID NO: 866214 - protein, 201 aa, Homo sapiens
MRVPRHPGGSHRSAVGLLCEKGPAAPSLVQIRCQTVFLGIHPNRSLISLCGSPGPPSRPEPKCLGSRERPVPFFSSLATSSHFRLLTVPKQPPKTLRELGPGPEAENGRKKRSGRISHRAPLLMLLGDTFIRPAPGGERRGKEVFSSRPPGARLGVVCGGGGRIWGPQSQPPLAAAAFIPEILLLTINRNPEKSQRCEVHT

SEQ ID NO: 866215 - protein, 151 aa, Homo sapiens; identical to SEQ ID NO: 866213

SEQ ID NO: 866216 - protein, 154 aa, Homo sapiens
MRVPRHPGGSHRSAVGLLCEKGPAAPSLVQIRCQTVFLGIHPNRSLISLCGSPGPPSRPEPKCLGSRERPVPFFSSLATSSHFRLLTVPKQPPKTLRELGPGPEAENGRKKRSGRFIKLSLQILQYRHCLLSSLWMVCTHPCLQVFRKNAQELF

SEQ ID NO: 866217 - protein, 891 aa, Homo sapiens
MKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866218 - protein, 137 aa, Homo sapiens
ELGAGGNPCQLVKPCGRKVYVDIGVYLNLFLQPLCLGWAVNDNGMAGVCCSHHALLPSSGRRKPKDLKLGFGGRFQPLPTPLAPHPLLPSPERRCFYQERLLKDVLFYFSLTFPSLKKWGKKKKKDKIDHKRPKKKK

SEQ ID NO: 866219 - protein, 1192 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866220 - protein, 1223 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAAHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866221 - protein, 1272 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQMKLLRLAEVNYYALDGQVGIGSQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866222 - protein, 1039 aa, Homo sapiens
NIIVELGLFRTRVTPGPGHSMLWRVLLSKRPPFPHPELDFQEAPIPSCPGRLPGRKNSVALAAAPRKEPTGDREKPLPFPVLAPFSNPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866223 - protein, 1241 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866224 - protein, 738 aa, Homo sapiens
KANTFWPRSFWTTLLLATLLLATLLLATLLLATLLLATLLLATLLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866225 - protein, 1249 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866226 - protein, 288 aa, Homo sapiens
MCCRYASGNTNVTHVSDRPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866227 - protein, 185 aa, Homo sapiens [sequence omitted]

SEQ ID NO: 866228 - protein, 194 aa, Homo sapiens
EIVSSCPEHSCPVSSTFVSFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866229 - protein, 1022 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISKMAPVCVSCFPKQALRATYL

SEQ ID NO: 866230 - protein, 1017 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASIRGPPSERGRLQVKLLV

SEQ ID NO: 866231 - protein, 618 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAVCLPPW

SEQ ID NO: 866232 - protein, 301 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPDTL

SEQ ID NO: 866233 - protein, 1042 aa, Homo sapiens
KIDVMSPVPVLLVTWVTPGPGHSMLWRVLLSKRPPFPHPELDFQEAPIPSCPGRLPGRKNSVALAAAPRKEPTGDREKPLPFPVLAPFSNPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866234 - protein, 1249 aa, Homo sapiens; identical to SEQ ID NO: 866225

SEQ ID NO: 866235 - protein, 1182 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKAHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866236 - protein, 1227 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866237 - protein, 967 aa, Homo sapiens
SSLLRRCRPCWESRRAEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866238 - protein, 1231 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866239 - protein, 1305 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPIAQHCLIEGSGGTSGPQEHQPLDHLGFVITIFSPCCSHHALLPSSGRRKPKDLKLGFGGRFQPLPTPLAPHPLLPSPERRCFYQERLLKDVLFYFSLTFPSLKKWGKKKKKDKIDHKRPKKKK

SEQ ID NO: 866240 - protein, 261 aa, Homo sapiens
DAILAYRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 866241 - protein, 102 aa, Homo sapiens
EESRSVARLECSGTISAHCNLRLPVSSVSCLSLPSSWDYRCALPRPANFCIFSRDGVSPCWPGWSRSLDLMIHPPPTPPTGQPVREDAKWTSQHSNTQTLGK

SEQ ID NO: 866242 - protein, 1008 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASIRDGTDCK

SEQ ID NO: 866243 - protein, 942 aa, Homo sapiens
RREARARPPPAADRVVCLARRASPPSVHIAAAPEPGSPGRPGGGGEGGTGLEACRARGGGVLRGTGGGGRTPRRPGLQSGGPSSPPAPLVGLGFTAAASNWEGAAPRVNPDPSLQGLGPSAPEEGVAGALLAKFEAGEAASGAPGFSGGAGAQMATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVLRMLAKLFVSEPHIAFYNMSRVQIRNRPGSEHVQIATRSVGKRR

SEQ ID NO: 866244 - protein, 123 aa, Homo sapiens
QEVENFKKVNMISREQFDTLTPEPPVDPNQEVPPGPPRFQQGEKQTPEILTWVRGSRALGLGAILGWMPQAFPCFLTPLSASAVPTDALANKLFGAPEPSTIARSLPTTVPESPNYRNTRTPR

SEQ ID NO: 866245 - protein, 167 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYRGGKICLTDHFKPLWARNVPKFGLAHLMALGLGPWLAVEIPDLIQKGVIQHKEKCNQ

SEQ ID NO: 866246 - protein, 167 aa, Homo sapiens; identical to SEQ ID NO: 866245

SEQ ID NO: 866247 - protein, 134 aa, Homo sapiens
KDLILCFQYVENNKNADNDWFRLESNKEGTRWFGKCWYIHDLLKYEFDIEFDIPITYPTTAPEIAVPELDGKTAKMYRGGKICLTDHFKPLWARNVPKFGLAHLMALGLGPWLAVEIPDLIQKGVIQHKEKCNQ

SEQ ID NO: 866248 - protein, 117 aa, Homo sapiens
FGTRRLESNKEGTRWFGKCWYIHDLLKYEFDIEFDIPITYPTTAPEIAVPELDGKTAKMYRGGKICLTDHFKPLWARNVPKFGLAHLMALGLGPWLAVEIPDLIQKGVIQHKEKCNQ

SEQ ID NO: 866249 - protein, 167 aa, Homo sapiens; identical to SEQ ID NO: 866245

SEQ ID NO: 866250 - protein, 167 aa, Homo sapiens; identical to SEQ ID NO: 866245

SEQ ID NO: 866251 - protein, 167 aa, Homo sapiens; identical to SEQ ID NO: 866245

SEQ ID NO: 866252 - protein, 148 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYRGGKICLTDHFKPLWARNVPKFGLAHLMALGVSFVYLA

SEQ ID NO: 866253 - protein, 122 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYSWVHGWQWKSLI

SEQ ID NO: 866254 - protein, 112 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPCSVKVSNTFSLVSQGGF

SEQ ID NO: 866255 - protein, 47 aa, Homo sapiens
MADEATRRVVSEIPVLKTNAGPRDRELWVQRLRDLLWSHGLKTSLGS

SEQ ID NO: 866256 - protein, 167 aa, Homo sapiens; identical to SEQ ID NO: 866245

SEQ ID NO: 866257 - protein, 167 aa, Homo sapiens; identical to SEQ ID NO: 866245

SEQ ID NO: 866258 - protein, 167 aa, Homo sapiens; identical to SEQ ID NO: 866245

SEQ ID NO: 866259 - protein, 113 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYSLD

SEQ ID NO: 866260 - protein, 111 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYR

SEQ ID NO: 866261 - protein, 114 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDCFLLGVASHIPRSPAGYPRMTHAAAAKIV

SEQ ID NO: 866262 - protein, 105 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDVSVIEWEIRRLVEGEGLDDG

SEQ ID NO: 866263 - protein, 70 aa, Homo sapiens
AGTPGPGGGPWGGRREAAACPGLGGWGERGGEMDKLTIISGCLFLAADIFAIASIANPDWINTGESAVSP

SEQ ID NO: 866264 - protein, 145 aa, Homo sapiens
AGTPGPGGGPWGGRREAAACPGLGGWGERGGEMDKLTIISGCLFLAADIFAIASIANPDWINTGESAALTVGLVRQCQTIHGRDRTCIPPRLPPEWVTTLFFIIMGIISLTVTCGLLVASHWRREATKYARWIAFTGKCVHSSHT

SEQ ID NO: 866265 - protein, 184 aa, Homo sapiens
AGTPGPGGGPWGGRREAAACPGLGGWGERGGEMDKLTIISGCLFLAADIFAIASIANPDWINTGESAGTHCGPRATVSNNPWTRPDVHPSPASPGVGHHTVFYHHGNHFIDCHMWFAGGFPLAKRSYKICSMDSIHWNHYEKIIGKTPRLEDSGFLLCKVNSSGSQLPSNKNKEFPHGLQILYY

SEQ ID NO: 866266 - protein, 198 aa, Homo sapiens
AGTPGPGGGPWGGRREAAACPGLGGWGERGGEMDKLTIISGCLFLAADIFAIASIANPDWINTGESAALTVGLVRQCQTIHGRDRTCIPPRLPPEWVTTLFFIIMGIISLTVTCGLLVASHWRREATKYARWIAFTGMILFCMAALIFPIGFYINEVGGQPYKLPNNTVVGSSYVLFVLSIFFTIVGLLFAGKVCLPG

SEQ ID NO: 866267 - protein, 105 aa, Homo sapiens
MACQISVFVALGELLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 866268 - protein, 117 aa, Homo sapiens
VKVRLELVQKAKTITTLEGIEVLKKLLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 866269 - protein, 126 aa, Homo sapiens
MVGRRNAPSRRKVAVVKTSACAGCVGAWRRSWKELLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 866270 - protein, 152 aa, Homo sapiens
MRVRGAWVPGDEAGKKFEKKFQSEKAAGSVSKSTQFEYAWCLVRSKYNDDIRKGIVLLEELLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 866271 - protein, 185 aa, Homo sapiens
HPPDAGSGSPPLPLGHGDCGTVDCSVRLAGAVAMEAVLNELVSVEDLLKFEKKFQSEKAAGSVSKSTQFEYAWCLVRSKYNDDIRKGIVLLEELLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 866272 - protein, 163 aa, Homo sapiens
HPPDAGSGSPPLPLGHGDCGTVDCSVRLAGAVAMEAVLNELVSVEDLLKFEKKFQSEKAAGSVSKSTQFEYAWCLVRSKYNDDIRKGIVLLEELLPKGSKEEQRDYVFYLAVGNYRLKEYEKALKYVRGLLQTEPQNNQAKELERLIDKAMKKDDSLGPFVQP

SEQ ID NO: 866273 - protein, 185 aa, Homo sapiens; identical to SEQ ID NO: 866271

SEQ ID NO: 866274 - protein, 185 aa, Homo sapiens; identical to SEQ ID NO: 866271

SEQ ID NO: 866275 - protein, 185 aa, Homo sapiens; identical to SEQ ID NO: 866271

SEQ ID NO: 866276 - protein, 106 aa, Homo sapiens
HPPDAGSGSPPLPLGHGDCGTVDCSVRLAGAVAMEAVLNELVSVEDLLARSLSTPGAWCGASTMMTSVKASCCSRSCCPKGARRNSGITSSTWPWGTTGSRNTRRP

SEQ ID NO: 866277 - protein, 161 aa, Homo sapiens
HPPDAGSGSPPLPLGHGDCGTVDCSVRLAGAVAMEAVLNELVSVEDLLVRPGPDRGKGKVGGRVLRKSELLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 866278 - protein, 79 aa, Homo sapiens
HPPDAGSGSPPLPLGHGDCGTVDCSVRLAGAVAMEAVLNELVSVEDLLSCCPKGARRNSGITSSTWPWGTTGSRNTRRP

SEQ ID NO: 866279 - protein, 427 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 866280 - protein, 427 aa, Homo sapiens; identical to SEQ ID NO: 866279

SEQ ID NO: 866281 - protein, 132 aa, Homo sapiens
LSFQNFFVVVHSPDSPLPFRSCLERSGRESTPAGEGLQGQDHRGLVVPSAQGLFTLPACFSPDGARLLTTDQKSEIRVYSASQWDCPLGLIPHPHRHFQHLTPIKVSGGGKELAEGGCDHEAGAGLPTVGKG

SEQ ID NO: 866282 - protein, 341 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIK

SEQ ID NO: 866283 - protein, 427 aa, Homo sapiens; identical to SEQ ID NO: 866279

SEQ ID NO: 866284 - protein, 413 aa, Homo sapiens
MKQGFLSGNSAEKPFVRLERKICLFCLAGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 866285 - protein, 291 aa, Homo sapiens [sequence omitted]

SEQ ID NO: 866286 - protein, 368 aa, Homo sapiens [sequence omitted]

SEQ ID NO: 866287 - protein, 114 aa, Homo sapiens
PGWYSPRGDIVDPRAPRQHSTTFCQLRHQWSIWFCSLDVSASSRMVVTGDNVGNVILLNMDGKELWNLRMHKKKVTHVALNPCCDWFLATASVDQTVKIWDLRQLVSVPMEPGS

SEQ ID NO: 866288 - protein, 267 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGAAWHPRYNLIVVGRYPDPNFKSCTPYELRTIDVFDGNSGKMMCQLYDPESSGISSLRIQSMGKVALDGYNFIAAGERKRGELEGGRLGQGKPRGVLGPTRGEAEAGGIGARRGGL

SEQ ID NO: 866289 - protein, 161 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGTGSCCVTQG

SEQ ID NO: 866290 - protein, 244 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELVSVPMEPGS

SEQ ID NO: 866291 - protein, 427 aa, Homo sapiens; identical to SEQ ID NO: 866279

SEQ ID NO: 866292 - protein, 244 aa, Homo sapiens; identical to SEQ ID NO: 866290

SEQ ID NO: 866293 - protein, 284 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQLVSVPMEPGS

SEQ ID NO: 866294 - protein, 188 aa, Homo sapiens
MHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 866295 - protein, 275 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKEMPKELTRWLNLWMVRTARNHGDWPAGKNQSYGEVVAGSRER

SEQ ID NO: 866296 - protein, 477 aa, Homo sapiens
DAPPPLHLCPERGMQPAPAPGQERLLGRGGVAEVYFLEKAPGFGLENPTAKIEPSSWSGSESPAENMERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 866297 - protein, 877 aa, Homo sapiens
NVPEPDGHIISPLLAGFYMFWTMIILLQVLIPISLYVSIEIVKLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIETDVVPDTKQVMVDFAALGPLTFQLLHILPFDSVRKRMSVVVRHPLSNQVVVYTKGADSVIMELLSVASPDGASLEKQQMIVREKTQKHLDDYAKQGLRTLCIAKKVMSDTEYAEWLRNHFLAETSIDNREELLLESAMRLENKLTLLGATGIEDRLQEGVPESIEALHKAGIKIWMLTGDKQETAVNIAYACKLLEPDDKLFILNTQSKDACGMLMSTILKELQKKTQALPEQVSLSEDLLQPPVPRDSGLRAGLIITGKTLEFALQESLQKQFLELTSWCQAVVCCRATPLQKSEVVKLVRSHLQVMTLAIGDGANDVSMIQVADIGIGVSGQEGMQAVMASDFAVSQFKHLSKLLLVHGHWCYTRLSNMILYFFYKNVAYVNLLFWYQFFCGFSGTSMTDYWVLIFFNLLFTSAPPVIYGVLEKDVSAETLMQLPELYRSGQKSEAYLPHTFWITLLDAFYQSLVCFFVPYFTYQGSDTDIFAFGNPLNTAALFIVLLHLVIESKSLTWIHLLVIIGSILSYFLFAIVFGAMCVTCNPPSNPYWIMQEHMLDPVFYLVCILTTSIALLPRFVYRVLQGSLFPSPILRAKHFDRLTPEERTKALKKWRGAGKMNQVTSKYANQSAGKSGRRPMPGPSAVFAMKSASSCAIEQGNLSLCETALDQGYSETKAFEMAGPSKGKES

SEQ ID NO: 866298 - protein, 708 aa, Homo sapiens
NVPEPDGHIISPLLAGFYMFWTMIILLQVLIPISLYVSIEIVKLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIETDVVPDTKQVMVDFAALGPLTFQLLHILPFDSVRKRMSVVVRHPLSNQVVVYTKGADSVIMELLSVASPDGASLEKQQMIVREKTQKHLDDYAKQGLRTLCIAKKVMSDTEYAEWLRNHFLAETSIDNREELLLESAMRLENKLTLLGATGIEDRLQEGVPESIEALHKAGIKIWMLTGDKQETAVNIAYACKLLEPDDKLFILNTQSKDACGMLMSTILKELQKKTQALPEQVSLSEDLLQPPVPRDSGLRAGLIITGKTLEFALQESLQKQFLELTSWCQAVVCCRATPLQKSEVVKLVRSHLQVMTLAIGDGANDVSMIQVADIGIGVSGQEGMQAVMASDFAVSQFKHLSKLLLVHGHWCYTRLSNMILYFFYKNVAYVNLLFWYQFFCGFSGTSMTDYWVLIFFNLLFTSAPPVIYGVLEKDVSAETLMQLPELYRSGQKSEAYLPHTFWITLLDAFYQSLVCFFVPYFTYQGSDTDIFAFGNPLNTAALFIVLLHLVIESKSLFLEPCV

SEQ ID NO: 866299 - protein, 721 aa, Homo sapiens
NVPEPDGHIISPLLAGFYMFWTMIILLQVLIPISLYVSIEIVKLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIETDVVPDTKQVMVDFAALGPLTFQLLHILPFDSVRKRMSVVVRHPLSNQVVVYTKGADSVIMELLSVASPDGASLEKQQMIVREKTQKHLDDYAKQGLRTLCIAKKVMSDTEYAEWLRNHFLAETSIDNREELLLESAMRLENKLTLLGATGIEDRLQEGVPESIEALHKAGIKIWMLTGDKQETAVNIAYACKLLEPDDKLFILNTQSKDACGMLMSTILKELQKKTQALPEQVSLSEDLLQPPVPRDSGLRAGLIITGKTLEFALQESLQKQFLELTSWCQAVVCCRATPLQKSEVVKLVRSHLQVMTLAIGDGANDVSMIQVADIGIGVSGQEGMQAVMASDFAVSQFKHLSKLLLVHGHWCYTRLSNMILYFFYKNVAYVNLLFWYQFFCGFSGTSMTDYWVLIFFNLLFTSAPPVIYGVLEKDVSAETLMQLPELYRSGQKSEAYLPHTFWITLLDAFYQSLVCFFVPYFTYQGSDTDIFAFGNPLNTAALFIVLLHLVIESKSLTRCSDSHLQFQSFGRLWIT

SEQ ID NO: 866300 - protein, 877 aa, Homo sapiens; identical to SEQ ID NO: 866297

SEQ ID NO: 866301 - protein, 877 aa, Homo sapiens; identical to SEQ ID NO: 866297

SEQ ID NO: 866302 - protein, 1651 aa, Homo sapiens
ARRKRCRSAQGLLPPPPLHRLPERACRAPPSPLSFLGELRGWGGRGSPSARRNRRRRRPRLRCRAPEPPSPPRALPGGGPPSPMEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 866303 - protein, 152 aa, Homo sapiens
VTVSLCHPGWSAVAQSWLTATSASQIQVINPQFVFDIKKTPHIDGCLSVIAQAFMDAFSLTEQQLGKEAPTNKLLYAKDIPTYKEEVKSYYKAIRDLPPLSSSEMEEFLTQESKVSLESRNKLIFGYFTSFQNLSTSLSFRNMKMNLMKKWP

SEQ ID NO: 866304 - protein, 699 aa, Homo sapiens
ARRKRCRSAQGLLPPPPLHRLPERACRAPPSPLSFLGELRGWGGRGSPSARRNRRRRRPRLRCRAPEPPSPPRALPGGGPPSPMEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRYLLNSFSPTRIFEKVIMRQNTCCPTLTIHSSDLRELISSSTKILLCNPNEFSKVFPAASVLCNHWTRELPSLGAGGAGVQPSGERERAGRFGFYFLQSSPRLKREAKGPPLREDKRIEMSENFSAESPSCMSCILF

SEQ ID NO: 866305 - protein, 274 aa, Homo sapiens
AGLRVTTLGLNQKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRYLLNSFSPTRIFEKDVMRQNTCCPTLTIHSSDLRELISSSTKILLCNPNEFSKVFPAASVLCNHWTRELPSLGAGGAGVQPSGERERAGRFGFYFLQSSPRLKREAKGPPLREDKRIEMSENFSAESPSCMSCILF

SEQ ID NO: 866306 - protein, 1630 aa, Homo sapiens
ARRKRCRSAQGLLPPPPLHRLPERACRAPPSPLSFLGELRGWGGRGSPSARRNRRRRRPRLRCRAPEPPSPPRALPGGGPPSPMEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKVSLESRNKLIFGYFTSFQNLSTSLSFRNMKMNLMKKWP

SEQ ID NO: 866307 - protein, 1353 aa, Homo sapiens
ARRKRCRSAQGLLPPPPLHRLPERACRAPPSPLSFLGELRGWGGRGSPSARRNRRRRRPRLRCRAPEPPSPPRALPGGGPPSPMEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLGKAVRELCGPRP

SEQ ID NO: 866308 - protein, 674 aa, Homo sapiens
MQSREDAPRSRRLASPRGGKRPKKIHKPTVSAFFTGPEELKDTAHSAALLAQLKSFYDARLLCDVTIEVVTPGSGPGTGRLFPCNRNVLAAACPYFKSMFTGGMYESQQASVTMHDVDAESFEVLVDYCYTGRVSLSEANVERLYAASDMLQLEYVREACASFLARRLDLTNCTAILKFADAFGHRKLRSQAQSYIAQNFKQLSHMGSIREETLADLTLAQLLAVLRLDSLDVESEQTVCHVAVQWLEAAPKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCCDPYSGDLYKVPSPLTCLAHTRTVTTLAVCISPDHDIYLAAQPRTDLWVYKPAQNSWQQLADRLLCREGMDVAYLNGYIYILGGRDPITGVKLKEVECYNVKRNQWALVAPLPHSFLSFDLMVIRDYLYALNSKRMFCYDPSHNMWLKCVSLKRNDFQEACVFNEEIYCICDIPVMKVYNPVRAEWRQMNNIPLVSETNNYRIIKHGQKLLLITSRTPQWKKNRVTVYEYDIRGDQWINIGTTLGLLQFDSNFFCLSARVYPSCLEPGQSFLTEEEEIPSESSTEWDLGGFSEPDSESGSSSSLSDDDFWVRVAPQ

SEQ ID NO: 866309 - protein, 674 aa, Homo sapiens; identical to SEQ ID NO: 866308

SEQ ID NO: 866310 - protein, 68 aa, Homo sapiens
TERGDVTEAGGNQRDSARQKNMKKQSDHRLRESAEDDGLFPAAARKQRDSEIMQQKQKKANEKKEEPK

SEQ ID NO: 866311 - protein, 69 aa, Homo sapiens
CVEAGEGEAEKEEAGAQVGLLRALQNCCSVPSPPSHSMRDAWRLRGPEDMHGRGQMRASKANEKKEEPK

SEQ ID NO: 866312 - protein, 68 aa, Homo sapiens
SSTTSQFQQPAVTSVSSARQKNMKKQSDHRLRESAEDDGLFPAAARKQRDSEIMQQKQKKADEMLEGG

SEQ ID NO: 866313 - protein, 118 aa, Homo sapiens
VGVPHFLEEQVAFSHPRLSNHRSVRPLDVRGCTRATLTGSACAYPTPAGAGNPLNPIRDGDRGLPIIPHERGIPSKFRSFARPKPPQTQGKGNATGPSTDGIPFALSNGGRLEPLPSP

SEQ ID NO: 866314 - protein, 127 aa, Homo sapiens
MTGFFLLPPASRGTRRSCSRSRKRQTRRRRNPSSFVASCPTLLPFACVPGSQSQTHARVSSCSAHRSQHRWHSLCPESAAGPFCASFPSGSLSSPWATPGGEGVTPSQCFLFLWGSPQSIKSSFVIP

SEQ ID NO: 866315 - protein, 234 aa, Homo sapiens
MTGFFLLPPASRGTRRSCSRSRKRQTRRRRNPSSFVASCPTLLPFACVPGSQSQTHARVSSCSAHRSQHRWHSLCPESAAGPFCASFPSGSLSSPWATPGGEGVTPSQCFLFLWGSPQSIKSSFVIPKKKKKKKKNCGGPGPRKVLKTSVCGAKVRDVRQRAQGDRPRTARFSPIKNRGTGRLHPEGSEAHGLNGPELICPPGTTALPHIDHSDHTYKPPRPDHTRPTTTTHTN

SEQ ID NO: 866316 - protein, 136 aa, Homo sapiens
MTGFFLLPPASRGTRRSCSRSRKRQTRRRRNPSSFVASCPTLLPFACVPGSQSQTHARVSSCSAHRSQHRWHSLCPESAAGPFCASFPSGSLSSPWATPGGEGVTPSQCFLFLWGSPQSIKSSFVIPKPHPHSTNM

SEQ ID NO: 866317 - protein, 128 aa, Homo sapiens
MTGFFLLPPASRGTRRSCSRSRKRQTRRRRNPSSFVASCPTLLPFACVPGSQSQTHARVSSCSAHRSQHRWHSLCPESAAGPFCASFPSGSLSSPWATPGGEGVTPSQCFLFLWGSPLVPNSARAKNL

SEQ ID NO: 866318 - protein, 118 aa, Homo sapiens; identical to SEQ ID NO: 866313

SEQ ID NO: 866319 - protein, 118 aa, Homo sapiens; identical to SEQ ID NO: 866313

SEQ ID NO: 866320 - protein, 121 aa, Homo sapiens
MATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 866321 - protein, 121 aa, Homo sapiens; identical to SEQ ID NO: 866320

SEQ ID NO: 866322 - protein, 121 aa, Homo sapiens; identical to SEQ ID NO: 866320

SEQ ID NO: 866323 - protein, 121 aa, Homo sapiens; identical to SEQ ID NO: 866320

SEQ ID NO: 866324 - protein, 121 aa, Homo sapiens; identical to SEQ ID NO: 866320

SEQ ID NO: 866325 - protein, 69 aa, Homo sapiens
SSTTAQSPQPAVTSVSSARQKNMKKQSDHRLRESAEDDGLFPAAARKQRDSEIMQQKQKKANEKKEEPK

SEQ ID NO: 866326 - protein, 69 aa, Homo sapiens; identical to SEQ ID NO: 866325

SEQ ID NO: 866327 - protein, 154 aa, Homo sapiens
SVWTLPLGSPDFLLRPCGSGYFWKSLREAGEIDMATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 866328 - protein, 90 aa, Homo sapiens
SSARFTEAEGLGDHAAEAEKGKREEGGTQVALWLRVQPSCPSPVCLGASPKPTLAFPPVVLTGPSTDGIPFALSLQRVPFVLPCQTVPSS

SEQ ID NO: 866329 - protein, 179 aa, Homo sapiens
MTGFFLLPPASRGTRRSCSRSRKRQTRRRRNPSSFVASCPTLLPFACVPGSQSQTHARVSSCSAHRSQHRWHSLCPESAAGPFCASFPSGSLSSPWATPGGEGVTPSQCFLFLWGSPQSIKSSFVIPKKKKKKNFRGLLMCRVWGKKGDLELGTVWHLGGVPGPTLSVFNGGKIRRPPL

SEQ ID NO: 866330 - protein, 127 aa, Homo sapiens; identical to SEQ ID NO: 866314

SEQ ID NO: 866331 - protein, 127 aa, Homo sapiens; identical to SEQ ID NO: 866314

SEQ ID NO: 866332 - protein, 118 aa, Homo sapiens; identical to SEQ ID NO: 866313

SEQ ID NO: 866333 - protein, 118 aa, Homo sapiens; identical to SEQ ID NO: 866313

SEQ ID NO: 866334 - protein, 176 aa, Homo sapiens
MTGFFLLPPASRASRTGAERRCGPGPAPPPPRAEAVSVAGSRREVGLMRRRGEIDMATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 866335 - protein, 174 aa, Homo sapiens
METGRLLSLSSLPLVLLGWEYSSQTLNLVPSTSILSFVPFIPLHLVLFALWYLPVPHHLYPQGLGDHAAEAEKGKREEGGTQVALWLRVQPSCPSPVCLGASPKPTLAFPPVVLTGPSTDGIPFALSLQRVPFVLPSPQVASRPPGPLPGVRGLPLPSVFYSCGAHPKVLKVAL

SEQ ID NO: 866336 - protein, 118 aa, Homo sapiens; identical to SEQ ID NO: 866313

SEQ ID NO: 866337 - protein, 121 aa, Homo sapiens; identical to SEQ ID NO: 866320

SEQ ID NO: 866338 - protein, 362 aa, Homo sapiens
ARETQLGLHGCGEILPRALFTMSVLDALWEDRDVRFDLSAQQMKTRPGEVLIDCLDSIEDTKGNNGDRGRLLVTNLRILWHSLALSRVNVSVGYNCILNITTRTANSKLRGQTEALYILTKCNSTRFEFIFTNLVPGSPRLFTSVMAVHRAYETSKMYRDFKLRSALIQNKQLRLLPQEHVYDKINGVWNLSSDQGNLGTFFITNVRIVWHANMNDSFNVSIPYLQIRSIKIRDSKFGLALVIESSQQSGGYVLGFKIDPVEKLQESVKEINSLHKVYSASPIFGVDYEMEEKPQPLEALTVEQIQDDVEIDSDGHTDAFVAYFADGNKQQDREPVFSEELGLAIEKLKDGFTLQGLWEVMS

SEQ ID NO: 866339 - protein, 106 aa, Homo sapiens
YCSLWANRGSWGTKCPIVLALLPPEHLGYLPPACCCCPGRSPAWVTGHRTGVSGQIGGRLSGSQEGLGCLKFQIMNKCILNYITKSEPEERLEVAEKRRPFQDVSE

SEQ ID NO: 866340 - protein, 107 aa, Homo sapiens
MPLSHVCTADSGHWVQSTPASWGNPGLSFPHQTEFGPHNTFHFFTPRASAANFCGHTLFIEKYRSLRSSSTSMSFWQPVAGKEMFSFILKQLYASGGLVPLPLNPTI

SEQ ID NO: 866341 - protein, 603 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866342 - protein, 603 aa, Homo sapiens; identical to SEQ ID NO: 866341

SEQ ID NO: 866343 - protein, 711 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQVSWRSPGAGESWGRLRMPGSGPCGLNVELSGSGSHQAHLVPTDGSRDLHRREAGLPHIPPESPGGVRLLQGAGQPAPLRPHYGGQAAELTLGQQPSQGLLIAALPSGLVPSSLPPASGAHTGWLPRCHVCSVPPSPGGWAELHHPCRWGLLYKLFLYMFGCGFYSLVPLPLNPTI

SEQ ID NO: 866344 - protein, 531 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSASLVPLPLNPTI

SEQ ID NO: 866345 - protein, 438 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGRFLPEQVGDSGTAR

SEQ ID NO: 866346 - protein, 289 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKNINREHEYGIFIDSPGR

SEQ ID NO: 866347 - protein, 363 aa, Homo sapiens
MYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866348 - protein, 529 aa, Homo sapiens
CRCAGEGMGWGHREGEKPTKTPLSSLGSPESSPVLPLPGNPLPSPPASIHLPIPPALSFPPTSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866349 - protein, 495 aa, Homo sapiens
SASGREVLGGGVLVMDARALEYPEEESQSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866350 - protein, 498 aa, Homo sapiens
NNTQNRSVTGTVFNLDEDTSCRGVGALTPERSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866351 - protein, 319 aa, Homo sapiens
MLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866352 - protein, 293 aa, Homo sapiens
MGQWNEGVSGTWCAVLRLSLQRYLCCCLSEPAGSRGPALLFSGALGLSTEPRWGAQQASLFPGVGHMCGAEGKRLVLTNNCLSVSVSEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866353 - protein, 86 aa, Homo sapiens
GVRPPTRLAPRPGKYILATDHTKLILCPLMAAVTYIDEKRDFRTYRLSLLEEYGCCKELASRLRYARTMVDKLLSSRSASNRLKAS

SEQ ID NO: 866354 - protein, 79 aa, Homo sapiens
ALQPPTEESLKTDHTKLILCPLMAAVTYIDEKRDFRTYRLSLLEEYGCCKELASRLRYARTMVDKLLSSRSASNRLKAS

SEQ ID NO: 866355 - protein, 603 aa, Homo sapiens; identical to SEQ ID NO: 866341

SEQ ID NO: 866356 - protein, 653 aa, Homo sapiens
IRPTLISSTQPEPKETKQIIRLGRRPVVNRPSGAVRRLCSDRGLQRSFGSMSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866357 - protein, 616 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHNQATSLEPHGWQTVNLIRSEKRGTFPDITGLKVHPVEGSKTLAATGAWPQHGTRLRPGTKVAKPDAHTIEPDNDLTGP

SEQ ID NO: 866358 - protein, 306 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKVTNDALSLHLFCFPQKLFMEPSNILGPEIGLSHL

SEQ ID NO: 866359 - protein, 516 aa, Homo sapiens
LGNWNCLRGSWSAQTWSCWKEYPARESLGLGAAREGCWEPPAYVWKVSLSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866360 - protein, 233 aa, Homo sapiens
SGASKTWWNCQAGDGETGRDIARSKELVIKQFVNGWAGSGICLKHLLDEGGGHGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 866361 - protein, 83 aa, Homo sapiens
PLALITNYVWMKGISTDHTKLILCPLMAAVTYIDEKRDFRTYRLSLLEEYGCCKELASRLRYARTMVDKLLSSRSASNRLKAS

SEQ ID NO: 866362 - protein, 164 aa, Homo sapiens
GAFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGR

SEQ ID NO: 866363 - protein, 88 aa, Homo sapiens
RLSSWRKMATAEKQKHDGRVKIGHYILGDTLGVGTFGKVKVGKHELTGHKVAVKILNRQKIRSLDVVGKIRREIQNLKLFRHPHIIKL

SEQ ID NO: 866364 - protein, 550 aa, Homo sapiens
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 866365 - protein, 263 aa, Homo sapiens
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDDRTRLDLKI

SEQ ID NO: 866366 - protein, 207 aa, Homo sapiens
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRDCNIIRILTSQFTNYQH

SEQ ID NO: 866367 - protein, 122 aa, Homo sapiens
MATAEKQKHDGRVKIGHYILGDTLGVGTFGKVKVGKHELTGHKVAVKILNRQKIRSLDVVGKIRREIQNLKLFRHPHIIKLVLKSFFLGCVRWLTPVIPVLWEAEAGGSPEVRSSRPAWPTW

SEQ ID NO: 866368 - protein, 479 aa, Homo sapiens
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDGMYITQNNID

SEQ ID NO: 866369 - protein, 271 aa, Homo sapiens
SGGDRDDKIFIEEMKSGSVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 866370 - protein, 265 aa, Homo sapiens
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIR

SEQ ID NO: 866371 - protein, 420 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 866372 - protein, 420 aa, Homo sapiens; identical to SEQ ID NO: 866371

SEQ ID NO: 866373 - protein, 420 aa, Homo sapiens; identical to SEQ ID NO: 866371

SEQ ID NO: 866374 - protein, 387 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKLPNGRDTPALFNFTTQDANTGDRGQTNNAASASASNST

SEQ ID NO: 866375 - protein, 501 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKDSSGTGHFTSGVRVFRPRTPPEAIALCSRLLEYTPTARLTVVYRAVGVYSSRGDHWKLVHIHFLMNYGTQMSNYQMGETHLHSSTSPLKNCQVIHLWLPSLFLLMLGFKQLLQPPQMPQQRQMLILETVDRPIMLLLHQLPTPPEQSRAASCTGKTTSYLSVTQQHWSRLERILKREKNPVHFSVQFFYYYCCSYLTL

SEQ ID NO: 866376 - protein, 137 aa, Homo sapiens [sequence omitted]

SEQ ID NO: 866377 - protein, 266 aa, Homo sapiens
HEESAIRIQQEVLRFNIPMADSKGMDIGKLRNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 866378 - protein, 433 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKDSSGTGHFTSGVRVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 866379 - protein, 277 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKYFERKT

SEQ ID NO: 866380 - protein, 163 aa, Homo sapiens
PAASLTCASFKCTQVLGTPTREQIREMNPNYTEFKFPQIKAHPWTKVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 866381 - protein, 396 aa, Homo sapiens
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCADKPGSSPDPSGEVNTNVAFCSVLRSRLGSHPLLFSGEVDCTDPQAPSTQPPTCYVELKTSKEMHSPGQWRSFYRHKLLKWWAQSFLPGVPNVVAGFRNPDGFVSSLKTFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 866382 - protein, 327 aa, Homo sapiens
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCADKPGSSPDPSGEVNTNVAFCSVLRSRLGSHPLLFSGLKTFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 866383 - protein, 166 aa, Homo sapiens
MYMGSNRTGRVGKRVGKLTRGGQEVDCTDPQAPSTQPPTCYVELKTSKEMHSPGQWRSFYRHKLLKWWAQSFLKTFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 866384 - protein, 113 aa, Homo sapiens
PRPGDDERSVNLSSLRPVSAGRGGGDAHTSITSARPGPTPAADWLPPRARTPGDSLAAWRGAGGHVGVNLLREAHTSPAPGGVCPPLSLNDCIIESRKPLLHPSASGVPAMTS

SEQ ID NO: 866385 - protein, 281 aa, Homo sapiens [sequence omitted]

SEQ ID NO: 866386 - protein, 335 aa, Homo sapiens [sequence omitted]

SEQ ID NO: 866387 - protein, 212 aa, Homo sapiens
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCAGELPLLHSPLPLPRG

SEQ ID NO: 866388 - protein, 396 aa, Homo sapiens; identical to SEQ ID NO: 866381

SEQ ID NO: 866389 - protein, 396 aa, Homo sapiens; identical to SEQ ID NO: 866381

SEQ ID NO: 866390 - protein, 281 aa, Homo sapiens [sequence omitted]

SEQ ID NO: 866391 - protein, 475 aa, Homo sapiens
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSSTGRRKQLYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSH

SEQ ID NO: 866392 - protein, 74 aa, Homo sapiens
IFCGVACGRGRMAGSTFCVSYSGLLCQFNEKRVLEKWINLKVPPPSLPSAGQTLSRDMCLQGCSSALTTQVLLM

SEQ ID NO: 866393 - protein, 706 aa, Homo sapiens
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKDASWELEENAYQELLQHYERCDVRRCRCKEGRDYNAPDSKWEIKRCQCCGSSGTHLACSSLRSWEQNWECLECRGIIYNSGEFQKAKKHVLPNSNNVGITDCLLEESSPKLPRQSPGSQSKDLLRQGSKFRRNVSTLLIELGFQIKKKTKRLYINKANIWNSALDAFRNRNFNPSYAIEVAYVIENDNFGSEHPGSKQEFLSLLMQHLENSSLFEGSLSKNLSLNSQALKENLYYEAGKMLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTLPDVKALGFWNSYLQAVEDGKSTTTMEDILIFATGCSSIPPAGFKPTPSIECLHVDFPVGNKCNNCLAIPITNTYKEFQENMDFTIRNTLRLEKEESSHYIGH

SEQ ID NO: 866394 - protein, 242 aa, Homo sapiens
KWEFESCGPLNVAARGRRAPTYSGPGKVALRLWNFCPALLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKSE

SEQ ID NO: 866395 - protein, 734 aa, Homo sapiens
KWEFESCGPLNVAARGRRAPTYSGPGKVALRLWNFCPALLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKDASWELEENAYQELLQHYERCDVRRCRCKEGRDYNAPDSKWEIKRCQCCGSSGTHLACSSLRSWEQNWECLECRGIIYNSGEFQKAKKHVLPNSNNVGITDCLLEESSPKLPRQSPGSQSKDLLRQGSKFRRNVSTLLIELGFQIKKKTKRLYINKANIWNSALDAFRNRNFNPSYAIEVAYVIENDNFGSEHPGSKQEFLSLLMQHLENSSLFEGSLSKNLSLNSQALKENLYYEAGKMLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTLPDVKALGFWNSYLQAVEDGKSTTTMEDILIFATGCSSIPPAGFKPTPSIECLHVDFPVGNKCNNCLAIPITNTYKEFQENMDFTIRNTLRLEKEESSHYIGH

SEQ ID NO: 866396 - protein, 706 aa, Homo sapiens; identical to SEQ ID NO: 866393

SEQ ID NO: 866397 - protein, 687 aa, Homo sapiens
MNESKPGDSQNLACVFCRKHDDCPNKYGEKKTKEKWNLTVHYYCLLMSSGIWQRGKEEEGVYGFLIEDIRKEVNRASKLKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKDASWELEENAYQELLQHYERCDVRRCRCKEGRDYNAPDSKWEIKRCQCCGSSGTHLACSSLRSWEQNWECLECRGIIYNSGEFQKAKKHVLPNSNNVGITDCLLEESSPKLPRQSPGSQSKDLLRQGSKFRRNVSTLLIELGFQIKKKTKRLYINKANIWNSALDAFRNRNFNPSYAIEVAYVIENDNFGSEHPGSKQEFLSLLMQHLENSSLFEGSLSKNLSLNSQALKENLYYEAGKMLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTLPDVKALGFWNSYLQAVEDGKSTTTMEDILIFATGCSSIPPAGFKPTPSIECLHVDFPVGNKCNNCLAIPITNTYKEFQENMDFTIRNTLRLEKEESSHYIGH

SEQ ID NO: 866398 - protein, 706 aa, Homo sapiens; identical to SEQ ID NO: 866393

SEQ ID NO: 866399 - protein, 214 aa, Homo sapiens
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKSE

SEQ ID NO: 866400 - protein, 706 aa, Homo sapiens; identical to SEQ ID NO: 866393

SEQ ID NO: 866401 - protein, 706 aa, Homo sapiens; identical to SEQ ID NO: 866393

SEQ ID NO: 866402 - protein, 706 aa, Homo sapiens; identical to SEQ ID NO: 866393

SEQ ID NO: 866403 - protein, 706 aa, Homo sapiens; identical to SEQ ID NO: 866393

SEQ ID NO: 866404 - protein, 290 aa, Homo sapiens
MQHLENSSLFEGSLSKNLSLNSQALKENLYYEAGKMLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTLPDVKALGFWNSYLQAVEDGKSTTTMEDILIFATGCSSIPPAGFKPTPSIECLHVDFPVGNKCNNCLAIPITNTYKEFQENMDFTIRNTLRLEKEESSHYIGH

SEQ ID NO: 866405 - protein, 86 aa, Homo sapiens
LQTHSSDRPPLVKCFHMPHMCLLSFLGHFGGTVPLHSLKGSGIIGNPGSPSRLLSRAVDCKRPRKANWYPRPPASVFLHSLILFRR

SEQ ID NO: 866406 - protein, 210 aa, Homo sapiens
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQQMGNKALSVLWFQWHTFSLLLITVMGAKLGVFGM

SEQ ID NO: 866407 - protein, 101 aa, Homo sapiens
MVFHTAHLDISRTTMRWFRREFMQMRGQKWYSDPVHVLQAHDLGAPWSWTEEEAAQRESSWSRPALQPPLSRQPDGPARPPGMAPSHRPWLRSLGRSVTCR

SEQ ID NO: 866408 - protein, 101 aa, Homo sapiens; identical to SEQ ID NO: 866407

SEQ ID NO: 866409 - protein, 101 aa, Homo sapiens; identical to SEQ ID NO: 866407

SEQ ID NO: 866410 - protein, 101 aa, Homo sapiens; identical to SEQ ID NO: 866407

SEQ ID NO: 866411 - protein, 104 aa, Homo sapiens
SIPAAGQDSNPHLSGSTVDLHMRQLLLVKQDGRTQPIGVDGAGQSLLKTFRAQHSPASSTGQCIEAGSLLQAMFFLQQFCFWNAEFGAHACNPSTLGGQGRRIA

SEQ ID NO: 866412 - protein, 125 aa, Homo sapiens
CAGRGLISASGWRFPVSCSGSLAVTMELLGEYVGQEGKPQKLRVSCEAPGDGDPFQGLLSGVAQMKDMVTELFDPLVQGEVQHRVAAAPDEDLDGDDEDDAEDENNIDNRTNFDGPSAKRPKTPS

SEQ ID NO: 866413 - protein, 125 aa, Homo sapiens; identical to SEQ ID NO: 866412

SEQ ID NO: 866414 - protein, 106 aa, Homo sapiens
CAGRGLISASGWRFPVSCSGSLAVTMELLGEYVGQEGKPQKLRVSCEAPGDGDPFQGLLSGVAQMKDMVMMKMMQKMKITLITELTSMDHLQNGQKHRLNNSLHDI

SEQ ID NO: 866415 - protein, 125 aa, Homo sapiens; identical to SEQ ID NO: 866412

SEQ ID NO: 866416 - protein, 219 aa, Homo sapiens
MPLHSGLGDRVRLCLKKQHQQKQQTTTNKQQTAPRGAAAKESSTGGAPPYGVNQGIEQQQEAHQDNGGEHTPETTADVEHNKQERGNAVTKRKKAEHHQQGGGHNKEQDTHQERKTRARHKQNHEHAYRGQADGQWEPAHTLATQTAALRAQIQRENEKEARRNRAQKRTGEEPREHSTRSSDDTHTQGNGSNAQKERHAASNQSERHAHTTSEGENRR

SEQ ID NO: 866417 - protein, 533 aa, Homo sapiens
MKMRRYKLFLMFCMAGLCLISFLHFFKTLSYVTFPRELASLSPNLVSSFFWNNAPVTPQASPEPGGPDLLRTHSTPTLPLLQPLPPSKAAEELHRVDLVLPEDTTEYFVRTKAGGVCFKPGTKMLERPPPGRPEEKPEGANGSSARRPPRYLLSARERTGGRGARRKWVECVCLPGWHGPSCGVPTVVQYSNLPTKERLVPREVPRRVINAINVNHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTVDMLQAVYGLDGIRLRRRQYYTMPNFRQYENRTGHILVQWSLGSPLHFAGWHCSWCFTPEGIYFKLVSAQNGDFPRWGDYEDKRDLNYIRGLIRTGGWFDGTQQEYPPADPSEHMYAPKYLLKNYDRFHYLLDNPYQEPRSTAAGGWRHRGPEGRPPARGKLDEAEV

SEQ ID NO: 866418 - protein, 531 aa, Homo sapiens
MRRYKLFLMFCMAGLCLISFLHFFKTLSYVTFPRELASLSPNLVSSFFWNNAPVTPQASPEPGGPDLLRTHSTPTLPLLQPLPPSKAAEELHRVDLVLPEDTTEYFVRTKAGGVCFKPGTKMLERPPPGRPEEKPEGANGSSARRPPRYLLSARERTGGRGARRKWVECVCLPGWHGPSCGVPTVVQYSNLPTKERLVPREVPRRVINAINVNHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTVDMLQAVYGLDGIRLRRRQYYTMPNFRQYENRTGHILVQWSLGSPLHFAGWHCSWCFTPEGIYFKLVSAQNGDFPRWGDYEDKRDLNYIRGLIRTGGWFDGTQQEYPPADPSEHMYAPKYLLKNYDRFHYLLDNPYQEPRSTAAGGWRHRGPEGRPPARGKLDEAEV

SEQ ID NO: 866419 - protein, 533 aa, Homo sapiens; identical to SEQ ID NO: 866417

SEQ ID NO: 866420 - protein, 99 aa, Homo sapiens
ECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 866421 - protein, 99 aa, Homo sapiens; identical to SEQ ID NO: 866420

SEQ ID NO: 866422 - protein, 178 aa, Homo sapiens
MWVDRISPSSPPRTSSGAISTPRAGPPATRPGTHRWAKFPRLHVRASSAVTRKSTSSRRPTLSGSGFFRVAAFRRTRLPWETAAMAAPRQIPSHIVRLKPSCSTDSSFTRTPVPTVSLASRELPVSSWQVTEPSSKNLWEQICKGCASRGNAFSWLQCRALFSGFPFHHDLTYTLSSR

SEQ ID NO: 866423 - protein, 260 aa, Homo sapiens
MWVDRISPSSPPRTSSGAISTPRAGPPATRPGTHRWAKFPRLHVRASSAVTRKSTSSRRPTLSGSGFFRVAAFRRTRLPWETAAMAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFERKRTKFIACDFLTEWLYK

SEQ ID NO: 866424 - protein, 257 aa, Homo sapiens
MWVDRISPSSPPRTSSGAISTPRAGPPATRPGTHRWAKFPRLHVRASSAVTRKSTSSRRPTLSGSGFFRVAAFRRTRLPWETAAMAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFEIDCSPWHLSTPCQLS

SEQ ID NO: 866425 - protein, 150 aa, Homo sapiens
MDLSGGYRSLVYVNHEKQLPERKRTKFIACDFLTEWLYNQNPKRAGEPFTEFFSIPFVEERLKQHPRPPIPLSLLLTEEEAALYIQSFWRACVVRCDPEIQELRQWQKKLREAKHIHQQVKIFWAKQEQKVKCKMEDDAVPAAKMKIPSS

SEQ ID NO: 866426 - protein, 299 aa, Homo sapiens
MWVDRISPSSPPRTSSGAISTPRAGPPATRPGTHRWAKFPRLHVRASSAVTRKSTSSRRPTLSGSGFFRVAAFRRTRLPWETAAMAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFEVRCDPEIQELRQWQKKLREAKHIHQQVKIFWAKQEQKVKCKMEDDAVPAAKMKIPSS

SEQ ID NO: 866427 - protein, 371 aa, Homo sapiens
MWVDRISPSSPPRTSSGAISTPRAGPPATRPGTHRWAKFPRLHVRASSAVTRKSTSSRRPTLSGSGFFRVAAFRRTRLPWETAAMAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFERKRTKFIACDFLTEWLYNQNPKRAGEPFTEFFSIPFVEERLKQHPRPPIPLSLLLTEEEAALYIQSFWRACVVRCDPEIQELRQWQKKLREAKHIHQQVKIFWAKQEQKVKCKMEDDAVPAAKMKIPSS

SEQ ID NO: 866428 - protein, 211 aa, Homo sapiens
MWVDRISPSSPPRTSSGAISTPRAGPPATRPGTHRWAKFPRLHVRASSAVTRKSTSSRRPTLSGSGFFRVAAFRRTRLPWETAAMAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCE

SEQ ID NO: 866429 - protein, 371 aa, Homo sapiens; identical to SEQ ID NO: 866427

SEQ ID NO: 866430 - protein, 273 aa, Homo sapiens
MWVDRISPSSPPRTSSGAISTPRAGPPATRPGTHRWAKFPRLHVRASSAVTRKSTSSRRPTLSGSGFFRVAAFRRTRLPWETAAMAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFEPTAANPTLAPADRRGSSPLHSILLESLCGSL

SEQ ID NO: 866431 - protein, 287 aa, Homo sapiens
LAQPYSQAPVMTLYPSGKGGCSASYSLQICSHRFLLDGSVTCHDETGSSRDARDTVGTGVRVNDESVEQLGLRRTMWLGICRVAPVEEMLFHGFSAEHYFPVSHFTMISRTPCPQDKSETINPKTCSPKEYLETFIFPVLLPGMASLLHQAKKEKCFERKRTKFIACDFLTEWLYNQNPKRAGEPFTEFFSIPFVEERLKQHPRPPIPLSLLLTEEEAALYIQSFWRACVVRCDPEIQELRQWQKKLREAKHIHQQVKIFWAKQEQKVKCKMEDDAVPAAKMKIPSS

SEQ ID NO: 866432 - protein, 220 aa, Homo sapiens
MWVDRISPSSPPRTSSGAISTPRAGPPATRPGTHRWAKFPRLHVRASSAVTRKSTSSRRPTLSGSGFFRVAAFRRTRLPWETAAMAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTSHGRQSHSRSC

SEQ ID NO: 866433 - protein, 260 aa, Homo sapiens; identical to SEQ ID NO: 866423

SEQ ID NO: 866434 - protein, 267 aa, Homo sapiens
MWVDRISPSSPPRTSSGAISTPRAGPPATRPGTHRWAKFPRLHVRASSAVTRKSTSSRRPTLSGSGFFRVAAFRRTRLPWETAAMAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFEVVLQMTPSGGKACVWGHLPSSSHTI

SEQ ID NO: 866435 - protein, 104 aa, Homo sapiens
FIKKRALISNSSGGRSLRSRHQQIGCLMRACCLPPRWHLVATFSRGEELCAFFIWQRDRRAKKKGQTPSVKPFYNDINPFVRALPSRPEHLPKGPTSQQYCIGD

SEQ ID NO: 866436 - protein, 365 aa, Homo sapiens
MYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSDVIKAVSTIAVHEKEESLWPRVAVFSTLAPGVLHGARLRSLQVVDLESRKTTYTSDVSDSEELSSLQVLDADTFAFCCASGRLGLVDTRQKWAPLENRSPGPGSGGERWCAEVGSWGQGPGPSIASLGSDGRLCLLDPRDLCHPVSSVQCPVSVPSPDPELLRVTWAPGLKNCLAISGFDGTVQVYDATSWDGTRSQDGTRSQVEPLFTHRGHIFLDGNGMDPAPLVTTHTWHPCRPRTLLSATNDASLHVWDWVDLCAPR

SEQ ID NO: 866437 - protein, 365 aa, Homo sapiens; identical to SEQ ID NO: 866436

SEQ ID NO: 866438 - protein, 199 aa, Homo sapiens
MYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSDVIKAVSTIAVHEKEESLWPRVAVFSTLAPGVLHGARLRSLQVVDLESRKTTYTSGTVVLCPLLAAPAGITPQPNSATIKTEFNSLCQVLGIHSE

SEQ ID NO: 866439 - protein, 165 aa, Homo sapiens
MYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSDVIKAVSTIAVHEKEESLWPRVAVFSTLAPGVLHGARLRSLQVVDLESRKTTYTSGVGDTQ

SEQ ID NO: 866440 - protein, 107 aa, Homo sapiens
MGAGPGACLAGGWVWVEARWGSWCRVGQLWPRGSPPWRTPPGPRPPSLGNGSFLRARVVRLLVGAALVKTQCPVSLRQPLSSAQNTDDLIDSSRQPWEIWVPWDVHT

SEQ ID NO: 866441 - protein, 107 aa, Homo sapiens; identical to SEQ ID NO: 866440

SEQ ID NO: 866442 - protein, 107 aa, Homo sapiens; identical to SEQ ID NO: 866440

SEQ ID NO: 866443 - protein, 106 aa, Homo sapiens
MYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSGE

SEQ ID NO: 866444 - protein, 365 aa, Homo sapiens; identical to SEQ ID NO: 866436

SEQ ID NO: 866445 - protein, 107 aa, Homo sapiens; identical to SEQ ID NO: 866440

SEQ ID NO: 866446 - protein, 107 aa, Homo sapiens; identical to SEQ ID NO: 866440

SEQ ID NO: 866447 - protein, 280 aa, Homo sapiens
MSLSKVCYPSKVWQVAEDSDVIKAVSTIAVHEKEESLWPRVAVFSTLAPGVLHGARLRSLQVVDLESRKTTYTSDVSDSEELSSLQVLDADTFAFCCASGRLGLVDTRQKWAPLENRSPGPGSGGERWCAEVGSWGQGPGPSIASLGSDGRLCLLDPRDLCHPVSSVQCPVSVPSPDPELLRVTWAPGLKNCLAISGFDGTVQVYDATSWDGTRSQDGTRSQVEPLFTHRGHIFLDGNGMDPAPLVTTHTWHPCRPRTLLSATNDASLHVWDWVDLCAPR

SEQ ID NO: 866448 - protein, 107 aa, Homo sapiens; identical to SEQ ID NO: 866440

SEQ ID NO: 866449 - protein, 506 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEE

SEQ ID NO: 866450 - protein, 316 aa, Homo sapiens
MGVGAAEPQLLSVPAGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEE

SEQ ID NO: 866451 - protein, 405 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYR

SEQ ID NO: 866452 - protein, 673 aa, Homo sapiens
MRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 866453 - protein, 872 aa, Homo sapiens
MPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGEQVITEEGGEVVVGWALLVHKGPWYELEEGSSFLTMRGVDAAQNTTWRAELGYMSTKAYARALRGCIHYTYYNWEQTWPYEMRLAWLGACTLGALHRLSLSPRRETETCLSPPTPGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEGEQAAFPSVL

SEQ ID NO: 866454 - protein, 4344 aa, Homo sapiens
MPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGEQVITEEGGEVVVGWALLVHKGPWYELEEGSSFLTMRGVDAAQNTTWRAELGYMSTKAYARALRGCIHYTYYNWEQTWPYEMRLAWLGACTLGALHRLSLSPRRETETCLSPPTPGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTEEETPSPTELSTEAREPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 866455 - protein, 4344 aa, Homo sapiens; identical to SEQ ID NO: 866454

SEQ ID NO: 866456 - protein, 4293 aa, Homo sapiens
MPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGEQVITEEGGEVVVGWALLVHKGPWYELEEGSSFLTMRGVDAAQNTTWRAELGYMSTKAYARALRGCIHYTYYNWEQTWPYEMRLAWLGACTLGALHRLSLSPRRETETCLSPPTPGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTEEETPSPTELSTEAREPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISYYRGRKKNPEGA

SEQ ID NO: 866457 - protein, 1808 aa, Homo sapiens
MPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGEQVITEEGGEVVVGWALLVHKGPWYELEEGSSFLTMRGVDAAQNTTWRAELGYMSTKAYARALRGCIHYTYYNWEQTWPYEMRLAWLGACTLGALHRLSLSPRRETETCLSPPTPGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTGEMGPYTAEPEATAFPPFSSLPLLSLPFVH

SEQ ID NO: 866458 - protein, 148 aa, Homo sapiens
QPCSLSSQIPAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTGEMGPYTAEPEATAFPPFSSLPLLSLPFVHLLCLI

SEQ ID NO: 866459 - protein, 4295 aa, Homo sapiens
MPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTEEREEESPPRPSLSQPPRRPWGNLTAELSRFRGTVQDLERHLRAHGYPLRANQTYTSVARHIHEYLQRQVLGSSADGALLVSLDGLRGQFERVVLRWRPQPPAEGPGGELTVPGTTRTVSLPDLRPGTTYHVEVHGVRAGQTSKSYAFITTTGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTEEETPSPTELSTEAREPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 866460 - protein, 80 aa, Homo sapiens
LPPVSTSLTSSLASFPPRAVSYRGAWWYRNCHYANLNGLYGSTVDHQGVSWYHWKGFEFSVPFTEMKLRPRNFRSPAGGG

SEQ ID NO: 866461 - protein, 3120 aa, Homo sapiens
MHFCAVNNLHSLTQHSYVGFGFPILLGPKSLPSLYPLFLVPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTEEETPSPTELSTEAREPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 866462 - protein, 4347 aa, Homo sapiens
MPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGEQVITEEGGEVVVGWALLVHKGPWYELEEGSSFLTMRGVDAAQNTTWRAELGYMSTKAYARALRGCIHYTYYNWEQTWPYEMRLAWLGACTLGALHRLSLSPRRETETCLSPPTPGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTEEETPSPTELSTEAREPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLSCCPPLSHPSMTAEH

SEQ ID NO: 866463 - protein, 1400 aa, Homo sapiens
MPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGEQVITEEGGEVVVGWALLVHKGPWYELEEGSSFLTMRGVDAAQNTTWRAELGYMSTKAYARALRGCIHYTYYNWEQTWPYEMRLAWLGACTLGALHRLSLSPRRETETCLSPPTPGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTEEREEESPPRPSLSQPPRRPWGNLTAELSRFRGTVQDLERHLRAHGYPLRANQTYTSVARHIHEYLQRQVLGSSADGALLVSLDGLRGQFERVVLRWRPQPPAEGPGGELTVPGTTRTVSLPDLRPGTTYHVEVHGVRAGQTSKSYAFITTTGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKICE

SEQ ID NO: 866464 - protein, 1123 aa, Homo sapiens
DGPYSKGGKDAGGADVSLACRRQSIPEEFRGITVVELIKKEGSTLGLTISGGTDKDGKPRVSNLRPGGLAARSDLLNIGDYIRSVNGIHLTRLRHDEIITLLKNVGERVVLEVEYELPPPAPENNPRIISKTVDVSLYKEGNSFGFVLRGGAHEDGHKSRPLVLTYVRPGGPADREGSLKVGDRLLSVDGIPLHGASHATALATLRQCSHEALFQVEYDVATPDTVANASGPLMVEIVKTPGSALGISLTTTSLRNKSVITIDRIKPASVVDRSGALHPGDHILSIDGTSMEHCSLLEATKLLASISEKVRLEILPVPQSQRPLRPSEAVKVQRSEQLHRWDPCVPSCHSPRPGHCRMPTWATPAGQDQSRSLSSTPFSSPTLNHAFSCNNPSTLPRGSQPMSPRTTMGRRRQRRREHKSSLSLASSTVGPGGQIVHTETTEVVLCGDPLSGFGLQLQGGIFATETLSSPPLVCFIEPDSPAERCGLLQVGDRVLSINGIATEDGTMEEANQLLRDAALAHKVVLEVEFDVAESVIPSSGTFHVKLPKKRSVELGITISSASRKRGEPLIISDIKKGSVAHRTGTLEPGDKLLAIDNIRLDNCPMEDAVQILRQCEDLVKLKIRKDEDNSDELETTGAVSYTVELKRYGGPLGITISGTEEPFDPIVISGLTKRGLAERTGAIHVGDRILAINNVSLKGRPLSEAIHLLQVAGETVTLKIKKQLDRPLLPRKSGSLSETSDADEDPADALKGGLPAARFSPAVPSVDSAVESWDSSATEGGFGGPGSYTPQAAARGTTPQERRPGWLRGSPPPTEPRRTSYTPTPADESFPEEEEEDDWEPPTRLLCHRSPPRLICPCSNWPPTVLVAPNCVFPLFRVTNHCPGAPELPPRTPACLPAHPPYGPSSPTLGPGAPKTPQAPARPPACQELTLSGSYVYSPAPGPAREEGFWRMFGEALEDLESCGQSELLRELEASIMTGTVQRVALEGRPGHRPWQRGREVRASPAEMEELLLPTPLEMHKVTLHKDPMRHDFGFSVSDGLLEKGVYVHTVRPDGPAHRGGLQPFDRVLQVNHVRTRDFDCCLAVPLLAEAGDVLELIISRKPHTAHSSRAPRSPGPSSPRML

SEQ ID NO: 866465 - protein, 1029 aa, Homo sapiens
DGPYSKGGKDAGGADVSLACRRQSIPEEFRGITVVELIKKEGSTLGLTISGGTDKDGKPRVSNLRPGGLAARSDLLNIGDYIRSVNGIHLTRLRHDEIITLLKNVGERVVLEVEYELPPPAPENNPRIISKTVDVSLYKEGNSFGFVLRGGAHEDGHKSRPLVLTYVRPGGPADREGSLKVGDRLLSVDGIPLHGASHATALATLRQCSHEALFQVEYDVATPDTVANASGPLMVEIVKTPGSALGISLTTTSLRNKSVITIDRIKPASVVDRSGALHPGDHILSIDGTSMEHCSLLEATKLLASISEKVRLEILPVPQSQRPLRPSEAVKVQRSEQLHRWDPCVPSCHSPRPGHCRMPTWATPAGQDQSRSLSSTPFSSPTLNHAFSCNNPSTLPRGSQPMSPRTTMGRRRQRRREHKSSLSLASSTVGPGGQIVHTETTEVVLCGDPLSGFGLQLQGGIFATETLSSPPLVCFIEPDSPAERCGLLQVGDRVLSINGIATEDGTMEEANQLLRDAALAHKVVLEVEFDVAESVIPSSGTFHVKLPKKRSVELGITISSASRKRGEPLIISDIKKGSVAHRTGTLEPGDKLLAIDNIRLDNCPMEDAVQILRQCEDLVKLKIRKDEDNSDELETTGAVSYTVELKRYGGPLGITISGTEEPFDPIVISGLTKRGLAERTGAIHVGDRILAINNVSLKGRPLSEAIHLLQVAGETVTLKIKKQLDRPLLPRKSGSLSETSDADEDPADALKGGLPAARFSPAVPSVDSAVESWDSSATEGGFGGPGSYTPQAAARGTTPQERRPGWLRGSPPPTEPRRTSYTPTPADESFPEEEEEDDWEPPTSPAPGPAREEGFWRMFGEALEDLESCGQSELLRELEASIMTGTVQRVALEGRPGHRPWQRGREVRASPAEMEELLLPTPLEMHKVTLHKDPMRHDFGFSVSDGLLEKGVYVHTVRPDGPAHRGGLQPFDRVLQVNHVRTRDFDCCLAVPLLAEAGDVLELIISRKPHTAHSSRAPRSPGPSSPRML

SEQ ID NO: 866466 - protein, 100 aa, Homo sapiens
TLPVLCLSLALVMPPCPEALVRHSPFPAPTSENLQLELFQENPFLAHSASLSLSYLIYNKGVGLGDPGGPSLPDRQEISVALAWPISTQCLPLLHLKKLI

SEQ ID NO: 866467 - protein, 377 aa, Homo sapiens
GNETNSRETFLGRINDCYKRSLERKLPPSCMIGGIKETQGKHVILSGSTEVISNEGGRFCYPEFSSGEESEEDVLFSNMEEEHESWDESDEELLAMEIRMRGQPRFANFRANTLSPVRFFVDKKWNTIPLRNKSLQRICAVDYDDSYDEILNGYEENSVVSYGQGSIQSMVSSDSTSPDSSLTEESRSETASSLSQKICNGGLSPGNPGDSKDMKEIEPNYESPSSNNQDKDSSQASKSSIKVPETHKAVLALRLEEKDGKIAVQTEKEESKASTDVAGQAVTINLVPTEEQAKPYRVVNLEQPLCKPYTVVDVSAAMASEHLEGPVNSPKTKSSSSTPNSPVTSSSLTPGQISAHFQKSSAIRYQEVWTSSTSPTT

SEQ ID NO: 866468 - protein, 80 aa, Homo sapiens
RESVLVLREFVLVFVLVLREFVLVLRAGAKGIVCTLVGDSVRRSRNAKDTVNVLSFVAVVVERLFHWYLLHCIINDQMNE

SEQ ID NO: 866469 - protein, 42 aa, Homo sapiens
MNDGTWVLSSQTLSKSALYRHRGLLLLSPTPQSLGPQPIPGH

SEQ ID NO: 866470 - protein, 128 aa, Homo sapiens
LCISSPSGADLDSHPLVPRSGHRILELATEKGETWLPCRGHTISSPLRGLVRVTVGPLLEPQRRTHLSVGEFGRRTWAYRAQPFGSLFLLGADPPTALSLPAMHVVGPGPLWMAHGGLELSLPGGIFV

SEQ ID NO: 866471 - protein, 111 aa, Homo sapiens
MELGSDNTEPAPSRSCMSREGNRMWTARMNTCRPVPMGGGQKRPRLKPHPSCAHLHTVSFCGSQAILPTHLLTDVWEAAASLLLLVQLTTSSSALRLLPFILLQLNLSQSF

SEQ ID NO: 866472 - protein, 105 aa, Homo sapiens
MWCLAAIVNRPWRGHRKGLPATHDLLRACLLTYDPSSSHPSATPVRRYEEDLRCEEDREGLVLSPTLECSGVITAHCSLNFLDSSDFPASTSQELGPQVHATTPG

SEQ ID NO: 866473 - protein, 118 aa, Homo sapiens
LPNLRLSKRPEPPGARPLRGLMTYGSCRVALSQDGGQVACSGLPGDFAPLRPRSLLLSISGPRGCHKESVTRDGRWWPRPLAVCCVEGRIIIIIKLNIALMCQELLSQQWRCGAWPQS

SEQ ID NO: 866474 - protein, 111 aa, Homo sapiens; identical to SEQ ID NO: 866471

SEQ ID NO: 866475 - protein, 94 aa, Homo sapiens
GASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 866476 - protein, 123 aa, Homo sapiens
KPEEILGANPGAVSRVLASLGLGPVPTLSWHWEPQLQIPRGQKPALGPLHKVKHLRESPGRQSETPSEKKKKKKKDSGAVTQGALVRTMTRGKLRLDDWKAAPRTGAECGTGISGNKSFFYLS

SEQ ID NO: 866477 - protein, 106 aa, Homo sapiens
VCSGPSASLIPMACAQATLLGTRREMTTSDPVGMLAPEYLVYFPLLPASGCTPRPATVVSVSGSIQCTMDYDYDYMCLCFPLESEGQNTWAIRREPPKPSAKTTTL

SEQ ID NO: 866478 - protein, 404 aa, Homo sapiens
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 866479 - protein, 404 aa, Homo sapiens; identical to SEQ ID NO: 866478

SEQ ID NO: 866480 - protein, 359 aa, Homo sapiens [sequence omitted]

SEQ ID NO: 866481 - protein, 386 aa, Homo sapiens
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 866482 - protein, 115 aa, Homo sapiens [sequence omitted]

SEQ ID NO: 866483 - protein, 404 aa, Homo sapiens; identical to SEQ ID NO: 866478

SEQ ID NO: 866484 - protein, 288 aa, Homo sapiens
MLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 866485 - protein, 288 aa, Homo sapiens
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLFSHFSYLLDQ

SEQ ID NO: 866486 - protein, 316 aa, Homo sapiens
MSKKEERRSPRNISMKLGWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 866487 - protein, 79 aa, Homo sapiens
RFNQCNTTRGNEVISVMNRAKKAGELGPAVGSGPGDRPLSHILTSITLRKVSGSGNHHTGAACLASRRLRPHGEPQLVL

SEQ ID NO: 866488 - protein, 549 aa, Homo sapiens
ILHTWDFRLAALRLLPDMQGPWVLLLLGLRLQLSLGIIPVEEENPDFWNRQAAEALGAAKKLQPAQTAAKNLIIFLGDGMGVSTVTAARILKGQKKDKLGPETFLAMDRFPYVALSKTYSVDKHVPDSGATATAYLCGVKGNFQTIGLSAAARFNQCNTTRGNEVISVMNRAKKAGKSVGVVTTTRVQHASPAGAYAHTVNRNWYSDADVPASARQEGCQDIATQLISNMDIDVILGGGRKYMFPMGTPDPEYPDDYSQGGTRLDGKNLVQEWLAKHQGARYVWNRTELLQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDGETHAGEDVAVFARGPQAHLVHGVQEQTFIAHVMAFAACLEPYTACDLAPRAGTTDAAHPGPSVVPALLPLLAGTLLLLGTATAP

SEQ ID NO: 866489 - protein, 302 aa, Homo sapiens
MSEDEEKVKLRRLEPAIQKFIKIVIPTDLERLRKHQINIEKYQRCRIWDKLHEEHINAGRTVQQLRSNIREIEKLCLKVRKDDLVLLKRMIDPVKEEASAATAEFLQLHLESVEELKKQFNDEETLLQPPLTRSMTVGGAFHTTEAEASSQSLTQIYALPEIPQDQNAAESWETLEADLIELSQLVTDFSLLVNSQQEKIDSIADHVNSAAVNVEEGTKNLGKAAKYKLAALPVAGALIGGMVGGPIGLLAGFKVAGIAAALGGGVLGFTGGKLIQRKKQKMMEKLTSSCPDLPSQTDKKCS

SEQ ID NO: 866490 - protein, 645 aa, Homo sapiens
MLFKTNFIIIHRSNDYPFKMIPLGNHVLTVVMLVLILLRPILKLFFQNCLQRHFADHPRKGGMMVLCRTDQEFLEDFEVILKLSAVQGELHEIQKLPSVGCLPSCPPLSALRFLYRSKNQILVTSITEVEETCNIARKYTTFVFHQSAETKPCFVLTLNMKGVSQGPLCPSLLPYEILQEKDEEKPGGRFSSEMRWFFLLLSQNVAVVHRYLTNVEMMFLSNQRPNKRQGSFSSSLNLILKVQGYFLFLINTLLFLTGGSHNLQFINLMPFYKETSSGIINHQCKGSTWYVSTLLLSNRNEEIRNISVHIKLKKKTHKKCQRQIICSRSQKLVSTRLGFNQGLGKNPEGDLTECEALSSHLLRLMVFQTSFNIPNQAIATTEDNWTGNPEIRVLVGFVSCSRIFKSGAALFSHPSHESFNLSGHQLDSIPYIKPCPVNSPLNVVASISKYIHGHHPSKKTITSHPALDLPPTLSDSVPYITATRINNHVHLSFSAERFSVVPTEYQIKFESLRLAFTAFYVLAPALSLETHYSPSDNATKNPQEGFQGFSMVKVQTGNKPCLHFSGLKYFLYYFIIVSWGLFKLLDEPKTCILKKIFFSTRRNCFQFLNLQNNVSVVTCAFDSHSTSILQEHKSSSLEWTIVQLL

SEQ ID NO: 866491 - protein, 302 aa, Homo sapiens; identical to SEQ ID NO: 866489

SEQ ID NO: 866492 - protein, 302 aa, Homo sapiens; identical to SEQ ID NO: 866489

SEQ ID NO: 866493 - protein, 73 aa, Homo sapiens
ARAKLLQDGPPPGLGRVIGELGEDGWIRVQWDTGSTNSYRMGKEGKYDLKLAELPAPAQPSAEDSDTEDDSGG

SEQ ID NO: 866494 - protein, 1555 aa, Homo sapiens
MVENRYTESFFTGQNCRNNEKVTLVRIADLENHNNDGGFWTVIDGKVYDIKDFQTQSLTENSILAQFAGEDPVVALEAALQFEDTRESMHAFCVGQYLEPDQEGVTIPDLGSLSSPLIDTERNLGLLLGLHASYLAMSTPLSPVEIECAKWLQSSIFSGGLQTSQIHYSYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALDIEQVKHRTLPKSVVDVCRVVYQAKCSLIKTHQEQGRSYKEVCAPVIKRLRFLFNELRPAVCNDLSIMSKFKLLSSLPHWRRIAQKIIREPRKKRVPKKPESTDDEEKIGNEESDLEEACILPHSPINVDKRPIAIKSPKDKWQPLLSTVTDVHKYKWLKQNVQGLYPQSPLLSTIAEFALKEEPVDVEKRKCLLKQLERAEVRLEGIDTILKLYLVSKNFLLPSVPYAMFCGWQRLIPEGIDIGEPLTDCLKDVDLIPPFNRMLLEVTFGKLYAWAVQNIRNVLVDASAKFKELGIQPVPLQTITNENPSGPSLGTIPQAHFLLVMLSMLTLQHSANNLDLLLNSGTLALAQTALRLIGPSCDSVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQQTELVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPVVLVKSGAVSSLRDEGPSPFPVTLVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPLPAVAFNVNNLPFTEPMLSVWAQLVNLAGSKLEKHKIKKSTKQAFAGQVDLDLLRRQQLKLYILKAGRALFSHQDKLRQILSQPAVQETGTVHTDDGAVVSPDLGDMSPEGPQPPMILLQQLLASATQPSPVKAIFDKQELETAALAVVESTHPSSPGFEDCSSSEATTPVNVQHIRPARVKRRKQSPVPALPIVVQLMEMGFPRRNIEFALKSLTGASGNASGLPGVEALVGWLLDHSDIQVTELSDADTVSDEYSDEEVVEDMDDAAYSMSTGAVVTESQTYKNRAGFLGNDDYAVYVRENIQVGMMVRCCRTYEEVCEGDVMLAKSSSWTEMDCMISMCSVTGSRKGASTGLGTFMWNL

SEQ ID NO: 866495 - protein, 81 aa, Homo sapiens
TRLSSSTAVISTGRGPCRDPHVPQVRMARHPQATCSLTCPESVTARQCRAPTATCTIFFPLSPSTTYSFHTCTSEPWRNLK

SEQ ID NO: 866496 - protein, 871 aa, Homo sapiens
ARAKLLQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPGALVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPLPAVAFNVNNLPFTEPMLSVWAQLVNLAGSKLEKHKIKKSTKQAFAGQVDLDLLRRQQLKLYILKAGRALFSHQDKLRQILSQPAVQETGTVHTEPMDTEGSCICLLLWKHENNDGAVVSPDLGDMSPEGPQPPMILLQQLLASATQPSPVKAIFDKQELETAALAVVESTHPSSPGFEDCSSSEATTPVNVQHIRPARVKRRKQSPVPALPIVVQLMEMGFPRRNIEFALKSLTGASGNASGLPGVEALVGWLLDHSDIQVTELSDADTVSDEYSDEEVVEDMDDAAYSMSTGAVVTESQTYKNRAGFLGNDDYAVYVRENIQVGMMVRCCRTYEEVCEGDVMLAKSSSWTEMDCMISMCSVTGSRKGASTGLGTFMWNL

SEQ ID NO: 866497 - protein, 871 aa, Homo sapiens; identical to SEQ ID NO: 866496

SEQ ID NO: 866498 - protein, 428 aa, Homo sapiens
YKHIRWPAASTDVVGGIDGRLCLGGQVVHDDFGEVTMTRITLKGKITVQFSDMRTCRVCPLNQLKPLPAVAFNVNNLPFTEPMLSVWAQLVNLAGSKLEKHKIKKSTKQAFAGQVDLDLLRRQQLKLYILKAGRALFSHQDKLRQILSQPAVQETGTVHTDDGAVVSPDLGDMSPEGPQPPMILLQQLLASATQPSPVKAIFDKQELETAALAVVESTHPSSPGFEDCSSSEATTPVNVQHIRPARVKRRKQSPVPALPIVVQLMEMGFPRRNIEFALKSLTGASGNASGLPGVEALVGWLLDHSDIQVTELSDADTVSDEYSDEEVVEDMDDAAYSMSTGAVVTESQTYKNRAGFLGNDDYAVYVRENIQVGMMVRCCRTYEEVCEGDVMLAKSSSWTEMDCMISMCSVTGSRKGASTGLGTFMWNL

SEQ ID NO: 866499 - protein, 871 aa, Homo sapiens; identical to SEQ ID NO: 866496

SEQ ID NO: 866500 - protein, 871 aa, Homo sapiens; identical to SEQ ID NO: 866496

SEQ ID NO: 866501 - protein, 871 aa, Homo sapiens; identical to SEQ ID NO: 866496

SEQ ID NO: 866502 - protein, 507 aa, Homo sapiens
ARAKLLQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPGALVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPLPAVAFNVNNLPSLEAS

SEQ ID NO: 866503 - protein, 871 aa, Homo sapiens; identical to SEQ ID NO: 866496

SEQ ID NO: 866504 - protein, 871 aa, Homo sapiens; identical to SEQ ID NO: 866496

SEQ ID NO: 866505 - protein, 871 aa, Homo sapiens; identical to SEQ ID NO: 866496

SEQ ID NO: 866506 - protein, 871 aa, Homo sapiens; identical to SEQ ID NO: 866496

SEQ ID NO: 866507 - protein, 871 aa, Homo sapiens; identical to SEQ ID NO: 866496

SEQ ID NO: 866508 - protein, 862 aa, Homo sapiens
ARAKLLQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPGALVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPLPAVAFNVNNLPFTEPMLSVWAQLVNLAGSKLEKHKIKKSTKQAFAGQVDLDLLRRQQLKLYILKAGRALFSHQDKLRQILSQPAVQETGTVHTEPMDTEGSCICLLLWKHENNDGAVVSPDLGDMSPEGPQPPMILLQQLLASATQPSPVKAIFDKQELETAALAVVESTHPSSPGFEDCSSSEATTPVNVQHIRPARVKRRKQSPVPALPIVVQLMEMGFPRRNIEFALKSLTGASGNASGLPGVEALVGWLLDHSDIQVTELSDADTVSDEYSDEEVVEDMDDAAYSMSTGAVVTESQTYKNRAGFLGNDDYAVYVRENIQVSNCLKLEPRSVFHSANIWVCPICQTSVDRGPCPQGACLLVLEDIPDQ

SEQ ID NO: 866509 - protein, 673 aa, Homo sapiens
ARAKLLQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPGALVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPLPAVAFNVNNLPFTEPMLSVWAQLVNLAGSKLEKHKIKKSTKQAFAGQVDLDLLRRQQLKLYILKAGRALFSHQDKLRQILSQPAVQETGTVHTDDGAVVSPDLGDMSPEGPQPPMILLQQLLASATQPSPVKAIFDKQELEERMSRCCFWRRRTTKLEQILLFIRRMNSVCEKENTNATASN

SEQ ID NO: 866510 - protein, 591 aa, Homo sapiens
ARAKLLQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPGALVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPLPAVAFNVNNLPFTEPMLSVWAQLVNLAGSKLEKHKIKKSTKQAFAGQVDLDLLRRQQLKLYILKAGRALFSHQDKLRQILSQPAVQETGTVHTGVFLKSS

SEQ ID NO: 866511 - protein, 536 aa, Homo sapiens
ARAKLLQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPGALVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPVGELVLSYCMIREIDFTLEPSTNISTNSYRMGKEGKYDLKLAELPA

SEQ ID NO: 866512 - protein, 78 aa, Homo sapiens [sequence omitted]

SEQ ID NO: 866513 - protein, 1369 aa, Homo sapiens
MHAFCVGQYLEPDQEGVTIPDLGSLSSPLIDTERNLGLLLGLHASYLAMSTPLSPVEIECAKWLQSSIFSGGLQTSQIHYSYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALDIEQVKHRTLPKSVVDVCRVVYQAKCSLIKTHQEQGRSYKEVCAPVIKRLRFLFNELRPAVCNDLSIMSKFKLLSSLPHWRRIAQKIIREPRKKRVPKKPESTDDEEKIGNEESDLEEACILPHSPINVDKRPIAIKSPKDKWQPLLSTVTDVHKYKWLKQNVQGLYPQSPLLSTIAEFALKEEPVDVEKRKCLLKQLERAEVRLEGIDTILKLYLVSKNFLLPSVPYAMFCGWQRLIPEGIDIGEPLTDCLKDVDLIPPFNRMLLEVTFGKLYAWAVQNIRNVLVDASAKFKELGIQPVPLQTITNENPSGPSLGTIPQAHFLLVMLSMLTLQHSANNLDLLLNSGTLALAQTALRLIGPSCDSVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPLPAVAFNVNNLPFTEPMLSVWAQLVNLAGSKLEKHKIKKSTKQAFAGQVDLDLLRRQQLKLYILKAGRALFSHQDKLRQILSQPAVQETGTVHTEPMDTEGSCICLLLWKHENNDGAVVSPDLGDMSPEGPQPPMILLQQLLASATQPSPVKAIFDKQELETAALAVVESTHPSSPGFEDCSSSEATTPVNVQHIRPARVKRRKQSPVPALPIVVQLMEMGFPRRNIEFALKSLTGASGNASGLPGVEALVGWLLDHSDIQVTELSDADTVSDEYSDEEVVEDMDDAAYSMSTGAVVTESQTYKNRAGFLGNDDYAVYVRENIQVGMMVRCCRTYEEVCEGDVMLAKSSSWTEMDCMISMCSVTGSRKGASTGLGTFMWNL

SEQ ID NO: 866514 - protein, 852 aa, Homo sapiens
ARAKLLQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPGALVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPLPAVAFNVNNLPFTEPMLSVWAQLVNLAGSKLEKHKIKKSTKQAFAGQVDLDLLRRQQLKLYILKAGRALFSHQDKLRQILSQPAVQETGTVHTDDGAVVSPDLGDMSPEGPQPPMILLQQLLASATQPSPVKAIFDKQELETAALAVVESTHPSSPGFEDCSSSEATTPVNVQHIRPARVKRRKQSPVPALPIVVQLMEMGFPRRNIEFALKSLTGASGNASGLPGVEALVGWLLDHSDIQVTELSDADTVSDEYSDEEVVEDMDDAAYSMSTGAVVTESQTYKNRAGFLGNDDYAVYVRENIQVGMMVRCCRTYEEVCEGDVMLAKSSSWTEMDCMISMCSVTGSRKGASTGLGTFMWNL

SEQ ID NO: 866515 - protein, 871 aa, Homo sapiens; identical to SEQ ID NO: 866496

SEQ ID NO: 866516 - protein, 871 aa, Homo sapiens; identical to SEQ ID NO: 866496

SEQ ID NO: 866517 - protein, 871 aa, Homo sapiens; identical to SEQ ID NO: 866496

SEQ ID NO: 866518 - protein, 871 aa, Homo sapiens; identical to SEQ ID NO: 866496

SEQ ID NO: 866519 - protein, 871 aa, Homo sapiens; identical to SEQ ID NO: 866496

SEQ ID NO: 866520 - protein, 871 aa, Homo sapiens; identical to SEQ ID NO: 866496

SEQ ID NO: 866521 - protein, 871 aa, Homo sapiens; identical to SEQ ID NO: 866496

SEQ ID NO: 866522 - protein, 871 aa, Homo sapiens; identical to SEQ ID NO: 866496

SEQ ID NO: 866523 - protein, 871 aa, Homo sapiens; identical to SEQ ID NO: 866496

SEQ ID NO: 866524 - protein, 641 aa, Homo sapiens
ARAKLLQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPGALVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPLPAVAFNVNNLPFTEPMLSVWAQLVNLAGSKLEKHKIKKSTKQAFAGQVDLDLLRRQQLKLYILKAGRALFSHQDKLRQILSQPAVQETGTVHTDDGAVVSPDLGDMSPEGPQPPMILLQQLLASATQPSPVKAIFDKQELEVQPCSLDSF

SEQ ID NO: 866525 - protein, 516 aa, Homo sapiens
ARAKLLQDGPPPGLGRVIGELGEDGWIRVQWDTGSTNSYRMGKEGKYDLKLAELPAPAQPSAEDSDTEDDSEAEQTERNIHPTAMMFTSTINLLQTLCLSAGVHAEIMQSEATKTLCGLLQMLVESGTTDKTSNRLVYREQHRSWCTLGFVQSIALTLQVCGALSSPQWITLLMKVVEGHAPFTATSLQRQILAVHLLQAVLPSWDKTERVRDMKCLMEKLFDFLGSLLTMCSSDVPLLRGGGRLPSLYPGEERCSAVTQRWVAVSLPCVLVKSVQCRHSEVGGRLPSLYPGEERCSAVTQRWVAVSLPCVLVKSRVVPSLRGEWPSPFPGALVKSGAAASPLVSSSESTLRRRRVCPQASLTATHSSTLAEEVVALLHTLHSLTRWNGLINKYINSQLRSITHSFAGRPSKGAQLDDYFPDSENPEVGGLMAVLAVVGGIDGRLCLGGQVVHDDFGEVTMTRITLKGKITVQFSDMRTCRVCPLNQLKPVGELVLSYCMIREIDFTLEPSTNIST

SEQ ID NO: 866526 - protein, 67 aa, Homo sapiens
STVTDVHKYKWLKQNVQGLYPQSPLLSTIAEFALKEEPVDVEKRKCLLKQVTFDEKCFSALGNIHNT

SEQ ID NO: 866527 - protein, 197 aa, Homo sapiens
AESARCCLGCRGRERPSPRPATSGPAAGSRCGCEGPRLAAAARTGHGVGRRARLACLGEPRVKAAVMLTLASKLKRDDGLKGSRTAATASDSTRRVSVRDKLLVKEVAELEANLPCTCKVHFPDPNKLHCFQLTVTPDEGYYQGGKFQFETEVPDAYNMVDLLNFDDPLNIEAAEHHLRDKEDFRNKVDDYIKRYAR

SEQ ID NO: 866528 - protein, 251 aa, Homo sapiens
AESARCCLGCRGRERPSPRPATSGPAAGSRCGCEGPRLAAAARTGHGVGRRARLACLGEPRVKAAVMLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKEDFRNKVDDYIKRYAR

SEQ ID NO: 866529 - protein, 251 aa, Homo sapiens; identical to SEQ ID NO: 866528

SEQ ID NO: 866530 - protein, 230 aa, Homo sapiens
AESARCCLGCRGRERPSPRPATSGPAAGSRCGCEGPRLAAAARTGHGVGRRARLACLGEPRVKAAVMLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTEDFRNKVDDYIKRYAR

SEQ ID NO: 866531 - protein, 123 aa, Homo sapiens
RKAPAAVSAAAGESGRVPAPPLPVPPPGAGAAVRGRVSQQPPGPGMVLGAGPASPVSGSPEVAELEANLPCTCKVHFPDPNKLHCFQLTVTPASQSEMPDQDLAPQHHRDRGNMSEFIERTFN

SEQ ID NO: 866532 - protein, 251 aa, Homo sapiens; identical to SEQ ID NO: 866528

SEQ ID NO: 866533 - protein, 139 aa, Homo sapiens
AESARCCLGCRGRERPSPRPATSGPAAGSRCGCEGPRLAAAARTGHGVGRRARLACLGEPRVKAAVMLTLASKLKRDDGLKGSRTAATASDSTRRVSVRDKLLVKEVAELEANLPCTCKVHFPDPNKLHCFQLTVTPVY

SEQ ID NO: 866534 - protein, 129 aa, Homo sapiens
AESARCCLGCRGRERPSPRPATSGPAAGSRCGCEGPRLAAAARTGHGVGRRARLACLGEPRVKAAVMLTLASKLKRDDGLKGSRTAATASDSTRRVSVRDKLLVKEVAELEANLPYRVSLCCPSWSTVA

SEQ ID NO: 866535 - protein, 123 aa, Homo sapiens; identical to SEQ ID NO: 866531

SEQ ID NO: 866536 - protein, 251 aa, Homo sapiens; identical to SEQ ID NO: 866528

SEQ ID NO: 866537 - protein, 189 aa, Homo sapiens
AESARCCLGCRGRERPSPRPATSGPAAGSRCGCEGPRLAAAARTGHGVGRRARLACLGEPRVKAAVMLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLRMSFGD

SEQ ID NO: 866538 - protein, 555 aa, Homo sapiens
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVSPTPGCIRALMKMLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 866539 - protein, 555 aa, Homo sapiens; identical to SEQ ID NO: 866538

SEQ ID NO: 866540 - protein, 555 aa, Homo sapiens; identical to SEQ ID NO: 866538

SEQ ID NO: 866541 - protein, 305 aa, Homo sapiens
MLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 866542 - protein, 259 aa, Homo sapiens
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVIENVLSFSLVFLVYSVFKTNV

SEQ ID NO: 866543 - protein, 531 aa, Homo sapiens
MAALGCARLRWALRGAGRGLCPHGARAKAAIPAALPSDKATGAPGAGPGVRRRQRSLEEIPRLGQLRFFFQLFVQGYALQLHQLQVLYKAKYGPMWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 866544 - protein, 574 aa, Homo sapiens
MAALGCARLRWALRGAGRGLCPHGARAKAAIPAALPSDKATGAPGAGPGVRRRQRSLEEIPRLGQLRFFFQLFVQGYALQLHQLQVLYKAKYGPMWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEGTLAGRGAGEGNGSGRGCAPSPQGLLDSICPGLPPVMASVHYSAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 866545 - protein, 391 aa, Homo sapiens
MPCNCTSYREGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 866546 - protein, 434 aa, Homo sapiens
MPCNCTSYREGHHWYQLRQALNQRLLKPAEAALYTDAFNEVIDDFMTRLDQLRAESASGNQVSDMAQLFYYFALEGTLAGRGAGEGNGSGRGCAPSPQGLLDSICPGLPPVMASVHYSAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 866547 - protein, 213 aa, Homo sapiens
MAQSSVVLGIFFYLLIAGVVTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 866548 - protein, 220 aa, Homo sapiens
MAALGCARLRWALRGAGRGLCPHGARAKAAIPAALPSDKATGAPGAGPGVRRRQRSLEEIPRLGQLRFFFQLFVQGYALQLHQLQVLYKAKYGPMWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAANAFLEQDVANSFQGKVVEELSHVRQ

SEQ ID NO: 866549 - protein, 531 aa, Homo sapiens; identical to SEQ ID NO: 866543

SEQ ID NO: 866550 - protein, 424 aa, Homo sapiens
MAALGCARLRWALRGAGRGLCPHGARAKAAIPAALPSDKATGAPGAGPGVRRRQRSLEEIPRLGQLRFFFQLFVQGYALQLHQLQVLYKAKYGPMWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKELLAHTLSFCHFYHF

SEQ ID NO: 866551 - protein, 437 aa, Homo sapiens
MWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 866552 - protein, 270 aa, Homo sapiens
MAALGCARLRWALRGAGRGLCPHGARAKAAIPAALPSDKATGAPGAGPGVRRRQRSLEEIPRLGQLRFFFQLFVQGYALQLHQLQVLYKAKYGPMWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPNGPAVPAETVLS

SEQ ID NO: 866553 - protein, 104 aa, Homo sapiens
MAALGCARLRWALRGAGRGLCPHGARAKAAIPAALPSDKATGAPGAGPGVRRRQRSLEEIPRLGQLRFFFQLFVQGYALQLHQLQVTRGGIASWGWEWAPEQRG

SEQ ID NO: 866554 - protein, 326 aa, Homo sapiens
MKQDASRNAAYTVDCEDYVHVVEFNPFENGDSGNLIAYGGNNYVVIGTCTFQEEEADVEGIQYKTLRTFHHGVRVDGIAWSPETRLDSLPPVIKFCTSAADMKIRLFTSDLQDKNEYKVLEGHTDFINGLVFDPKEGQEIASVSDDHTCRIWNLEGVQTAHFVLHSPGMSVCWHPEETFKLMVAEKNGTIRFYDLLAQQAILSLESEQVPLMSAHWCLKNTFKVGAVAGNDWLIWDITRSSYPQNKRPVHMDRACLFRWSTISENLFATTGYPGKMASQFQIHHLGHPQPILMGSVAVGSGLSWHRTLPLCVIGGDHKLLFWVTEV

SEQ ID NO: 866555 - protein, 326 aa, Homo sapiens; identical to SEQ ID NO: 866554

SEQ ID NO: 866556 - protein, 379 aa, Homo sapiens
MKQDASRNAAYTVDCEDYVHVVEFNPFENGDSGNLIAYGGNNYVVIGTCTFQEEEADVEGIQYKTLRTFHHGVRVDGIAWSPETRLDSLPPVIKFCTSAADMKIRLFTSDLQDKNEYKVLEGHTDFINGLVFDPKEGQEIASVSDDHTCRIWNLEGVQTAHFVLHSPGMSVCWHPEETFKIMKDNSRSLNRFKWYSSGVLMPNPTFLPIYHYYLHLQGFFNLIEPELKEHCLKLMVAEKNGTIRFYDLLAQQAILSLESEQVPLMSAHWCLKNTFKVGAVAGNDWLIWDITRSSYPQNKRPVHMDRACLFRWSTISENLFATTGYPGKMASQFQIHHLGHPQPILMGSVAVGSGLSWHRTLPLCVIGGDHKLLFWVTEV

SEQ ID NO: 866557 - protein, 225 aa, Homo sapiens
MKIRLFTSDLQDKNEYKVLEGHTDFINGLVFDPKEGQEIASVSDDHTCRIWNLEGVQTAHFVLHSPGMSVCWHPEETFKLMVAEKNGTIRFYDLLAQQAILSLESEQVPLMSAHWCLKNTFKVGAVAGNDWLIWDITRSSYPQNKRPVHMDRACLFRWSTISENLFATTGYPGKMASQFQIHHLGHPQPILMGSVAVGSGLSWHRTLPLCVIGGDHKLLFWVTEV

SEQ ID NO: 866558 - protein, 144 aa, Homo sapiens
MPPRGKKQPQTDQRWVPSCYSRAGGEKWLSAFVFVQLSTRTARHKTHAENTVKQTKPTAANRPKRKDERPSRLTDKQGTTQTPTKTQKTTHRHGDQRHRHQHRTQTEKPIEQLEAVKTDKNDDKHESTSTTETEARRARTAQAT

SEQ ID NO: 866559 - protein, 326 aa, Homo sapiens; identical to SEQ ID NO: 866554

SEQ ID NO: 866560 - protein, 326 aa, Homo sapiens; identical to SEQ ID NO: 866554

SEQ ID NO: 866561 - protein, 291 aa, Homo sapiens
MKQDASRNAAYTVDCEDYVHVVEFNPFENGDSGNLIAYGGNNYVVIGTCTFQEEEADVEGIQYKTLRTFHHGVRVDGIAWSPETRLDSLPPVIKFCTSAADMKIRLFTSDLQDKNEYKVLEGHTDFINGLVFDPKEGQEIASVSDDHTCRNMEEQTQYEQQPSSVSWQPKKKQKEAKKGKNKKKIAQQKKQKTEQEPKNPAHRNPKAGAVAKKRPTPPPPPHPPHPPHTPPPRPTNRAGRPGRASGGRRVGHPQPILMGSVAVGSGLSWHRTLPLCVIGGDHKLLFWVTEV

SEQ ID NO: 866562 - protein, 75 aa, Homo sapiens
QGSLIILIPPPPPPPLFPSERAAALAACAAMAKIKARDLRGKKKEELLKQLDDLKVELSTAARRQSDRRCGLQAL

SEQ ID NO: 866563 - protein, 123 aa, Homo sapiens [sequence omitted]

SEQ ID NO: 866564 - protein, 67 aa, Homo sapiens
YCARYEAWVVSGPLAALAACAAMAKIKARDLRGKKKEELLKQLDDLKVELSPAARRQSDRRCGLQAL

SEQ ID NO: 866565 - protein, 71 aa, Homo sapiens
FAARATRLREDDRRGERAAALAACAAMAKIKARDLRGKKKEELLKQLDDLKVELSPAARRQSDRRCGLQAL

SEQ ID NO: 866566 - protein, 85 aa, Homo sapiens
DAWVAHASAESSGNPLPVFSQLLTRLRKKTSGNSTRARSTSPWTCGLRRHVPLRRRLNKHEENLKTKKQQRKERLYPLRKYAVKA

SEQ ID NO: 866567 - protein, 76 aa, Homo sapiens
ARRHPAVVAEVSPAYFLFPSERAAALAACAAMAKIKARDLRGKKKEELLKQLDDLKVELSPAARRQSDRRCGLQAL

SEQ ID NO: 866568 - protein, 83 aa, Homo sapiens
PFAGRPQVQGLVLLALVEFPEVFFLSLVNNCENTGKKYKPLDLRPKKTRAMRRRLNKHEENLKTKKQQRKERLYPLRKYAVKA

SEQ ID NO: 866569 - protein, 141 aa, Homo sapiens
MQAPALPQLCQDLDTQPSRSADLHEMRMVPPALDLGGLIELVTCVACWQSHGGSLLLSGSGWPSPAPLAAAVAPQPWVLGFTLPSVSQNSTRARSTSPWTCGLRRHVPLRRRLNKHEENLKTKKQQRKERLYPLRKYAVKA

SEQ ID NO: 866570 - protein, 71 aa, Homo sapiens
PFAGRPQVQGLVLLALVEFPEVFFLSLVNNCENTGNGFPDDSDLRELENLKTKKQQRKERLYPLRKYAVKA

SEQ ID NO: 866571 - protein, 75 aa, Homo sapiens; identical to SEQ ID NO: 866562

SEQ ID NO: 866572 - protein, 71 aa, Homo sapiens; identical to SEQ ID NO: 866565

SEQ ID NO: 866573 - protein, 113 aa, Homo sapiens
MVWRHHNPPLRLAPGEARGPGLGYSAQGTAGEGDCPEPWLGLRRTRSRWRVARLWGLATQVKGIWPRGLAEAHSLLRAGQDQGSRSSREEEGGAAETAGRPEGGAVPSCASPK

SEQ ID NO: 866574 - protein, 123 aa, Homo sapiens [sequence omitted]

SEQ ID NO: 866575 - protein, 71 aa, Homo sapiens; identical to SEQ ID NO: 866565

SEQ ID NO: 866576 - protein, 71 aa, Homo sapiens; identical to SEQ ID NO: 866565

SEQ ID NO: 866577 - protein, 71 aa, Homo sapiens; identical to SEQ ID NO: 866565

SEQ ID NO: 866578 - protein, 71 aa, Homo sapiens; identical to SEQ ID NO: 866565

SEQ ID NO: 866579 - protein, 71 aa, Homo sapiens; identical to SEQ ID NO: 866565

SEQ ID NO: 866580 - protein, 71 aa, Homo sapiens; identical to SEQ ID NO: 866565

SEQ ID NO: 866581 - protein, 75 aa, Homo sapiens; identical to SEQ ID NO: 866562

SEQ ID NO: 866582 - protein, 102 aa, Homo sapiens
MLPSKPTRTPSFRFPPTLEFLTPLAAESSGNPLPVFSQLLTRLRKKTSGNSTRARSTSPWTCGLRRHVPLRRRLNKHEENLKTKKQQRKERLYPLRKYAVKA

SEQ ID NO: 866583 - protein, 75 aa, Homo sapiens; identical to SEQ ID NO: 866562

SEQ ID NO: 866584 - protein, 75 aa, Homo sapiens; identical to SEQ ID NO: 866562

SEQ ID NO: 866585 - protein, 75 aa, Homo sapiens; identical to SEQ ID NO: 866562

SEQ ID NO: 866586 - protein, 75 aa, Homo sapiens; identical to SEQ ID NO: 866562

SEQ ID NO: 866587 - protein, 71 aa, Homo sapiens; identical to SEQ ID NO: 866565

SEQ ID NO: 866588 - protein, 85 aa, Homo sapiens
ARSSSEDLYISPLYPQRNASRTLNRLGQQQGAAALAACAAMAKIKARDLRGKKKEELLKQLDDLKVELSPAARRQSDRRCGLQAL

SEQ ID NO: 866589 - protein, 85 aa, Homo sapiens; identical to SEQ ID NO: 866588

SEQ ID NO: 866590 - protein, 76 aa, Homo sapiens; identical to SEQ ID NO: 866567

SEQ ID NO: 866591 - protein, 77 aa, Homo sapiens
REREREREREREREREREQWTQKENLRKGKKYKPLDLRPKKTRAMRRRLNKHEENLKTKKQQRKERLYPLRKYAVKA

SEQ ID NO: 866592 - protein, 161 aa, Homo sapiens
MLLLTRAEEFYKGKKYKPLDLRPKKTRAIAPPAQQARGEPEDQEAAAEGAAVPAAEVRGQGLRGALSIKHSWLRKKKKKKKKKKKNRGIMGGGGHKGDFGRAPGAIRVFPGTQLSVAHKRAKLGRGPKKGGDKHTKPRYRDNARPRNTPRNKTNTHHNTTK

SEQ ID NO: 866593 - protein, 71 aa, Homo sapiens; identical to SEQ ID NO: 866565

SEQ ID NO: 866594 - protein, 71 aa, Homo sapiens; identical to SEQ ID NO: 866565

SEQ ID NO: 866595 - protein, 71 aa, Homo sapiens; identical to SEQ ID NO: 866565

SEQ ID NO: 866596 - protein, 71 aa, Homo sapiens; identical to SEQ ID NO: 866565

SEQ ID NO: 866597 - protein, 71 aa, Homo sapiens; identical to SEQ ID NO: 866565

SEQ ID NO: 866598 - protein, 71 aa, Homo sapiens; identical to SEQ ID NO: 866565

SEQ ID NO: 866599 - protein, 71 aa, Homo sapiens; identical to SEQ ID NO: 866565

SEQ ID NO: 866600 - protein, 71 aa, Homo sapiens; identical to SEQ ID NO: 866565

SEQ ID NO: 866601 - protein, 71 aa, Homo sapiens; identical to SEQ ID NO: 866565

SEQ ID NO: 866602 - protein, 113 aa, Homo sapiens; identical to SEQ ID NO: 866573

SEQ ID NO: 866603 - protein, 75 aa, Homo sapiens; identical to SEQ ID NO: 866562

SEQ ID NO: 866604 - protein, 104 aa, Homo sapiens
MSVSSESGNPLARVLTVINQTQKENLRKFYKGKKYKPLDLRLRRHVPVAAGSTSTRENLKTKKQQRKERLYPLRKYAARPEGRIVNKAQLAEENKNYTTHTNTN

SEQ ID NO: 866605 - protein, 63 aa, Homo sapiens
MPDGRRQHTQKPRHAKLSHAPHLREHTTTHYGKSPRGPSYVYTINAARRHRHQHRTLPDNSYQ

SEQ ID NO: 866606 - protein, 75 aa, Homo sapiens; identical to SEQ ID NO: 866562

SEQ ID NO: 866607 - protein, 443 aa, Homo sapiens
QHPTGIRWPEAAACCSAGTMELSYRLFICLLLWGSTELCYPQPLWLLQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866608 - protein, 105 aa, Homo sapiens
LRLMEEKNWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNM

SEQ ID NO: 866609 - protein, 98 aa, Homo sapiens
LRLMEEKNWNAEKRSPTFHLGDAAHLQAEIHTGSHVPLRLFVDHCVATPTPDQNASPYHTIVDFHGCLVYGLIDASYAFKAPRPAPIHSLHSVCPPLP

SEQ ID NO: 866610 - protein, 133 aa, Homo sapiens
QHPTGIRWPEAAACCSAGTMELSYRLFICLLLWGSTELCYPQPLWLLQGGASHPETSVQPVLVECQEATLMVMVSKDLFGTGKLIRAADLTLGPEACEPLVSMDTEDVVRFEVGLHECGNSMQARMQWHDLRS

SEQ ID NO: 866611 - protein, 481 aa, Homo sapiens
LVVAAVVHTPAQALAGCQAGLAAFAVHVVQQDVSGAIAEEGVGGGGHGRPAAQLTTDHSGIRQPPVVVTHGAPQATVQDLHSALTQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866612 - protein, 316 aa, Homo sapiens
RNIIFRVPPAPPSANYGPGHSRRPQVASSVQTRSHAAQWTASLLPPVPLAPGFQGQLTFSASDEENETLKKNWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866613 - protein, 300 aa, Homo sapiens
RGVGDSMWSFIYLQVSTVLWERDIIKMLTTPQGHSPILLQTDSLAIRMVLFGFDAKIESLEMVSPLPFDRISSPAEEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866614 - protein, 296 aa, Homo sapiens
GEGARYQCELSAAQKGITGGECNSRPSAQLVPLGPGVLKEKLHFFLRLRRKNWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866615 - protein, 289 aa, Homo sapiens
SPLQKRDPRRSIGNQATLPPVGPSGPWCSKKKASSLFAWRGESQNWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866616 - protein, 284 aa, Homo sapiens
FNSQKDTSAGVGRASIPAPGALRARCFRRKTTSFCVEEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866617 - protein, 262 aa, Homo sapiens
MVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866618 - protein, 318 aa, Homo sapiens
SCRLLPARPIDYPLGTLNTSYNTLLSRSARTRHSQLAARQPPIPARRLALSVSGVARPRPYSLSPIKHPSRTQQGPAASPPANRATHYAANPPRQAPALLGSLGTPVGPTRHKTNRPPLFPPLWTSKAVLVPCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866619 - protein, 245 aa, Homo sapiens
MLTHRTLPALLLFGRSSPPLVRSPPCNHVPCGCLWTIGGAHLPEARMPPLITPCGEFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866620 - protein, 241 aa, Homo sapiens
PSPGNCGILTSRDYSGSTDHSVDVTIDVTTVTPDQNASPYNPIMYFHDVLVDDIGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866621 - protein, 411 aa, Homo sapiens
LVVAAVVHTPAQALAGCQAGLAAFAVHVVQQDVSGAIAEEGVGGGGHGRPAAQLTTDHSGIRQPPVVVTHGAPQATVQDLHSALTQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHV

SEQ ID NO: 866622 - protein, 413 aa, Homo sapiens
LVVAAVVHTPAQALAGCQAGLAAFAVHVVQQDVSGAIAEEGVGGGGHGRPAAQLTTDHSGIRQPPVVVTHGAPQATVQDLHSALTQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHAQL

SEQ ID NO: 866623 - protein, 334 aa, Homo sapiens
LVVAAVVHTPAQALAGCQAGLAAFAVHVVQQDVSGAIAEEGVGGGGHGRPAAQLTTDHSGIRQPPVVVTHGAPQATVQDLHSALTQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNM

SEQ ID NO: 866624 - protein, 334 aa, Homo sapiens; identical to SEQ ID NO: 866623

SEQ ID NO: 866625 - protein, 348 aa, Homo sapiens
LVVAAVVHTPAQALAGCQAGLAAFAVHVVQQDVSGAIAEEGVGGGGHGRPAAQLTTDHSGIRQPPVVVTHGAPQATVQDLHSALTQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMYLLTCPPKVPLSYL

SEQ ID NO: 866626 - protein, 315 aa, Homo sapiens
TRRSVKRRITTAHQSGGMTCFMNNPATITDADDGPTRALYRRTLGYYPAYTTLPLQDLTRHNVNITSHTLSGNPDSYGEGPPHTGEAVSILSQEATREPAGLTVNFDTQCAQTARGPEAPPYHTIEPLQRVHVNGLIEASGHTKFLDPARYIPVPSGSPPSDNDPSNLIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866627 - protein, 285 aa, Homo sapiens
GDEVLPHWTTNYVCTTYLLLTMAALAAEHHSTLCLADRASVARKLRCLNFTNRLTVSFLAAIQLFFHPTLRYTVGTYRAKTACWQAKSPPCKPLGELICLSSPCQLEAFYAMKFFDPGLDISSVLRGVLQLYNGSRRMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866628 - protein, 253 aa, Homo sapiens
MRDTMGFLLRSRKENSHYRNPPPPHKRRGPRDRDCKKKTAHPTCLTPGWQWVHASMLLCSHYIIFHDVIDLSLKEPVRELKILDPGLVTPVSKWSFPLCQWVQYKMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866629 - protein, 207 aa, Homo sapiens
RGAEVTTQAFPPYWAPRDARDERRKNIPQGRNTAGQRVNRAIHLPRGGACPPQGKSPPAPIGTRRVICAPPGGQPGNQDKKAPPLSNHGNFQGLFIRGFHRRPICELKVPGPGPRTIQFPGEVFPFVNDPKNLIYITCHLKVTLAEQDPDELNKACSFSKPSNRQQKSKLLLFHLTGSQWKARLTSVNAVTKVTVALQAIPGGSLMS

SEQ ID NO: 866630 - protein, 160 aa, Homo sapiens
MNCYTFVFDSPDDRLFHQPVTGNPVEQAPDEFKKACSLGKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866631 - protein, 141 aa, Homo sapiens
KQLLFYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNM

SEQ ID NO: 866632 - protein, 149 aa, Homo sapiens
MPIHQAQYSCLGVLPTVCWNGYHKKAVLSPRNSRMVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNM

SEQ ID NO: 866633 - protein, 82 aa, Homo sapiens
LVVAAVVHTPAQALAGCQAGLAAFAVHVVQQDVSGAIAEEGVGGGGHGRPAAQLTTDHSGIRQPPVVVTHGALAQRPTHRVV

SEQ ID NO: 866634 - protein, 283 aa, Homo sapiens
MSLKRSPAGQGRTRPSAPWSLQPTFLKETYFSSRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866635 - protein, 105 aa, Homo sapiens; identical to SEQ ID NO: 866608

SEQ ID NO: 866636 - protein, 481 aa, Homo sapiens; identical to SEQ ID NO: 866611

SEQ ID NO: 866637 - protein, 248 aa, Homo sapiens
MEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866638 - protein, 306 aa, Homo sapiens
SSSTPTIQRSHTGKLRANDPPSRFQQSTLEFGRPGLLPPVWPLGRGVNKHNITSPCVAGGQNWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866639 - protein, 291 aa, Homo sapiens
LSQKGPRQEMWGQAFCARVSLRTAVSPKERRYSSGFKRVNCYRKKKNWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866640 - protein, 290 aa, Homo sapiens
IFALRTTFSCRKRTTTVTAPPESFATCCLEARGFQSKNPSFSAKGKISTYQEATPSPHWKTAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866641 - protein, 252 aa, Homo sapiens
LRLMEEKNWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866642 - protein, 199 aa, Homo sapiens
MWNFHGCLERVSNCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866643 - protein, 276 aa, Homo sapiens
VKDTARGSIKQNDSGARNPDGNGVIQEKAFSFVFTKRTGSQQIVPPSPLKNKAASGANPQREHKPLGCMWTPGGPHRRQTECPPLSHHRDCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866644 - protein, 236 aa, Homo sapiens
NHTGKYSTPPGEETTTCSQGPCRMCEDHCGATLTLAKKPPREHAIVDSQDCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866645 - protein, 414 aa, Homo sapiens
LVVAAVVHTPAQALAGCQAGLAAFAVHVVQQDVSGAIAEEGVGGGGHGRPAAQLTTDHSGIRQPPVVVTHGAPQATVQDLHSALTQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSLFPRETLGLTSCHAATKVTWGLPAHSRWYLARLDHSFIFFFPYPPPWHQ

SEQ ID NO: 866646 - protein, 191 aa, Homo sapiens
VASGPGFREKVAFFGFEEKNWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNRQQKSKLLLFHLTGSQWKARLTSVNAVTKVTVALQAIPGGSLMS

SEQ ID NO: 866647 - protein, 338 aa, Homo sapiens
LVVAAVVHTPAQALAGCQAGLAAFAVHVVQQDVSGAIAEEGVGGGGHGRPAAQLTTDHSGIRQPPVVVTHGAPQATVQDLHSALTQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMRYLI

SEQ ID NO: 866648 - protein, 239 aa, Homo sapiens
MSYNGLSRKGGGRGCVRRSGEMDTPYMVNSRSSLIRWKYRKVPVYYRCGFAKAVISHGCRKHCWAFIEIVSGTGSLHFILDVFTLNKRPGDIIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866649 - protein, 148 aa, Homo sapiens
MIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866650 - protein, 148 aa, Homo sapiens; identical to SEQ ID NO: 866649

SEQ ID NO: 866651 - protein, 183 aa, Homo sapiens
MQGARWESEAPRPRATNIFPVGRLSLSSMTTLPEPLYAFTVHLKVSLTERAHIYFSSACSFSSLLYSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 866652 - protein, 351 aa, Homo sapiens
LVVAAVVHTPAQALAGCQAGLAAFAVHVVQQDVSGAIAEEGVGGGGHGRPAAQLTTDHSGIRQPPVVVTHGAPQATVQDLHSALTQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPCNTQTRPDCEVYGLTRAPLCIQTPSSHGPVLSPLTTDTLPLPARAPNSLFSLPYPPAANPICSWS

SEQ ID NO: 866653 - protein, 306 aa, Homo sapiens
LVVAAVVHTPAQALAGCQAGLAAFAVHVVQQDVSGAIAEEGVGGGGHGRPAAQLTTDHSGIRQPPVVVTHGAPQATVQDLHSALTQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEVTEEADVTVGPLIFLDRRGDHEVEQWALPSDTSVVLLGVGLAVVVSLTLTAVILVLTRRCRTASHPVSASE

SEQ ID NO: 866654 - protein, 331 aa, Homo sapiens
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLRQGLAKGWNAVAIHRCSHNALQSETPELKQSSCLSFPSSWDYKRASLCPSD

SEQ ID NO: 866655 - protein, 115 aa, Homo sapiens
PPAPAPAAARRPRFRSAPRRPGLGARTRTKDASSRRVGIPPASRTVPRAQPADHHPAARAAFVPRPPLLSERPPARRILTASVGSQSRARLGPEASISREPQGESCKDVKVKRRL

SEQ ID NO: 866656 - protein, 239 aa, Homo sapiens
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESEFS

SEQ ID NO: 866657 - protein, 515 aa, Homo sapiens [sequence omitted]

SEQ ID NO: 866658 - protein, 515 aa, Homo sapiens [sequence omitted]

SEQ ID NO: 866659 - protein, 515 aa, Homo sapiens [sequence omitted]

SEQ ID NO: 866660 - protein, 515 aa, Homo sapiens [sequence omitted]

SEQ ID NO: 866661 - protein, 259 aa, Homo sapiens [sequence omitted]

SEQ ID NO: 866662 - protein, 99 aa, Homo sapiens
LRNTPKGPSPSFFRRRRSFSPMSQVSSGEKGGPAQGNREEPSKFQSVSLGHLTHVTSCLLQLEFHLVQPSPVKVGKTDFRITCVTNTERKHGVGERDKT

SEQ ID NO: 866663 - protein, 331 aa, Homo sapiens; identical to SEQ ID NO: 866654

SEQ ID NO: 866664 - protein, 331 aa, Homo sapiens; identical to SEQ ID NO: 866654

SEQ ID NO: 866665 - protein, 515 aa, Homo sapiens [sequence omitted]

SEQ ID NO: 866666 - protein, 331 aa, Homo sapiens; identical to SEQ ID NO: 866654

SEQ ID NO: 866667 - protein, 515 aa, Homo sapiens [sequence omitted]

SEQ ID NO: 866668 - protein, 115 aa, Homo sapiens; identical to SEQ ID NO: 866655

SEQ ID NO: 866669 - protein, 346 aa, Homo sapiens
MSPTMSRTTSHAKSHTMSHTRSHSRSHTMGHPKSPTKSQEGSWWHSDEQAVIKSPLKCTLLPPGQESESAESAKIGGIITVFLIALVLTSTIVTLKWIGYICLRNSLPKVLNFHNFLAWPFPNLPPLEAMDMVEVIYINRKKKVWDYNYDDESDSDTEAAPRTSGGGYTMHGLTVRPLGQASATSTESQLIDPESEEEPDLPEVDVELPTMPKDSPQQLELLSGPCERRKSPLQDPFPEEDYSSTEGSGGRITFNVDLNSVFLRVLDDEDSDDLEAPLMLSSHLEEMVDPEDPDNVQSNHLLASGEGTQPTFPSPSSEGLWSEDAPSDQSDTSESDVDLGDGYIMR

SEQ ID NO: 866670 - protein, 107 aa, Homo sapiens
MWILSNLMGTSEEGNLLSTVSPTVKALFGKTRVSPIFPFSPRSPFQPLIPRTPGSPWGPVGPASPLGPGFPIGPMGPGKPVGPKGPMLPLGPSGPVGPTSPLFPFCP

SEQ ID NO: 866671 - protein, 490 aa, Homo sapiens
MAQRAVWLISHEPGTPLCGTVRFSRRYPTVEKRARVFNGASYVPVPEDGPFLKALLFELRLLDDDKDFVESRDSCSRINKTSIYGLLIGGEELWPVVAFLKNDMIYACVPLVEQTLSPRPPLISVSGVSQGFEFLFGIQDFLYSGQKNDSELNTKLSQLPDLLLQACPFGTLLDANLQNSLDNTNFASVTQPQKQPAWKTGTYKGKPQVSISITEKVKSMQYDKQGIADTWQVVGTVTCKCDLEGIMPNVTISLSLPTNGSPLQDILVHPCVTSLDSAILTSSSIDAMDDSAFSGPYKFPFTPPLESFNLCFYTSQVPVPPILGFYQMKEEEVQLRITINLKLHESVKNNFEFCEAHIPFYNRGPITHLEYKTSFGQLEVFREKSLLIWIIGQKFPKSMEISLSGTVTFGAKSHEKQPFDPICTGETAYLKLHFRILDYTLTGCYADQHSVQVFASGKPKISAHRKLISSDYYIWNSKAPAPVTYGSLLL

SEQ ID NO: 866672 - protein, 504 aa, Homo sapiens
MAQRAVWLISHEPGTPLCGTVRFSRDWQEDSGYLLIHYKRYPTVEKRARVFNGASYVPVPEDGPFLKALLFELRLLDDDKDFVESRDSCSRINKTSIYGLLIGGEELWPVVAFLKNDMIYACVPLVEQTLSPRPPLISVSGVSQGFEFLFGIQDFLYSGQKNDSELNTKLSQLPDLLLQACPFGTLLDANLQNSLDNTNFASVTQPQKQPAWKTGTYKGKPQVSISITEKVKSMQYDKQGIADTWQVVGTVTCKCDLEGIMPNVTISLSLPTNGSPLQDILVHPCVTSLDSAILTSSSIDAMDDSAFSGPYKFPFTPPLESFNLCFYTSQVPVPPILGFYQMKEEEVQLRITINLKLHESVKNNFEFCEAHIPFYNRGPITHLEYKTSFGQLEVFREKSLLIWIIGQKFPKSMEISLSGTVTFGAKSHEKQPFDPICTGETAYLKLHFRILDYTLTGCYADQHSVQVFASGKPKISAHRKLISSDYYIWNSKAPAPVTYGSLLL

SEQ ID NO: 866673 - protein, 244 aa, Homo sapiens
MPNVTISLSLPTNGSPLQDILVHPCVTSLDSAILTSSSIDAMDDSAFSGPYKFPFTPPLESFNLCFYTSQVPVPPILGFYQMKEEEVQLRITINLKLHESVKNNFEFCEAHIPFYNRGPITHLEYKTSFGQLEVFREKSLLIWIIGQKFPKSMEISLSGTVTFGAKSHEKQPFDPICTGETAYLKLHFRILDYTLTGCYADQHSVQVFASGKPKISAHRKLISSDYYIWNSKAPAPVTYGSLLL

SEQ ID NO: 866674 - protein, 321 aa, Homo sapiens [sequence omitted]

SEQ ID NO: 866675 - protein, 490 aa, Homo sapiens; identical to SEQ ID NO: 866671

SEQ ID NO: 866676 - protein, 244 aa, Homo sapiens; identical to SEQ ID NO: 866673

SEQ ID NO: 866677 - protein, 284 aa, Homo sapiens
MAQRAVWLISHEPGTPLCGTVRFSRRYPTVEKRARVFNGASYVPVPEDGPFLKALLFELRLLDDDKDFVESRDSCSRINKTSIYGLLIGGEELWPVVAFLKNDMIYACVPLVEQTLSPRPPLISVSGVSQGFEFLFGIQDFLYSGQKNDSELNTKLSQLPDLLLQACPFGTLLDANLQNSLDNTNFASVTQPQKQPAWKTGTYKGKPQVSISITEKVKSMQYDKQGIADTWQVVGTVTCKVRFFSGTCFIVLFNIWRKVKFASCILNNIFYFHLKQQFLNGRVM

SEQ ID NO: 866678 - protein, 490 aa, Homo sapiens; identical to SEQ ID NO: 866671

SEQ ID NO: 866679 - protein, 284 aa, Homo sapiens; identical to SEQ ID NO: 866677

SEQ ID NO: 866680 - protein, 168 aa, Homo sapiens
RSPPEWMIAVSGPGLEAVIDCAVAKVLTRVAMRMAVGASRLLTECPPVGTASQAFDKHLPGNRARCPESLDWMSRWGERDRDTQAGAQASQGHWFTGVITPSPAIAIRLHCGQLSPRRGWRGLVSGRHCWCVWSVLVSPASCIGDCWVAGREMGRESVGVMVVKAAGF

SEQ ID NO: 866681 - protein, 441 aa, Homo sapiens
MEISSHQSHLLQQLNEQRRQDVFCDCSILVEGKVFKAHRNVLFASSGYFKMLLSQNSKETSQPTTATFQAFSPDTFTVILDFVYSGKLSLTGQNVIEVMSAASFLQMTDVISVCKTFIKSSLDISEKEKDRYFSLSDKDANSNGVERSSFYSGGWQEGSSSPRSHLSPEQGTGIISGKSWNKYNYHPASQKNTQQPLAKHEPRKESIKKTKHLRLSQPSEVTHYKSSKREVRTSDSSSHVSQSEEQAQIDAEMDSTPVGYQYGQGSDVTSKSFPDDLPRMRFKCPYCTHVVKRKADLKRHLRCHTGERPYPCQACGKRFSRLDHLSSHFRTIHQACKLICRKCKRHVTDLTGQVVQEGTRRYRLCNECLAEFGIDSLPIDLEAEQHLMSPSDGDKDSRWHLSEDENRSYVEIVEDGSADLVIQQVDDSEEEEEKEIKPNIR

SEQ ID NO: 866682 - protein, 441 aa, Homo sapiens; identical to SEQ ID NO: 866681

SEQ ID NO: 866683 - protein, 340 aa, Homo sapiens
MEISSHQSHLLQQLNEQRRQDVFCDCSILVEGKVFKAHRNVLFASSGYFKMLLSQNSKETSQPTTATFQAFSPDTFTVILDFVYSGKLSLTGQNVIEVMSAASFLQMTDVISVCKTFIKSSLDISEKEKDRYFSLSDKDANSNGVERSSFYSGGWQEGSSSPRSHLSPEQGTGIISGKSWNKYNYHPASQKNTQQPLAKHEPRKESIKKTKHLRLSQPSEVTHYKSSKREVRTSDSSSHVSQSEEQAQIDAEMDSTPVGYQYGQGSDVTSKSFPDDLPRMRFKCPYCTHVVKRKADLKRHLRCHTGERPYPCQACGKRFSRLDHLSSHFRTMEIRIPDGT

SEQ ID NO: 866684 - protein, 272 aa, Homo sapiens
AGPAEGGGFGGVNCAVSAPFSLTCSCASLHLRLCFFSQHCGRDSRVTLAPLVPLVMAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 866685 - protein, 288 aa, Homo sapiens
AGPAEGGGFGGVNCAVSAPFSLTCSCASLHLRLCFFSQHCGRDSRVTLAPLVPLVMAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDCGGMNVINFEHLDTERPESVCKSD

SEQ ID NO: 866686 - protein, 232 aa, Homo sapiens
MWMDLNHQLSLEGSQDLKFPRSQLFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 866687 - protein, 198 aa, Homo sapiens
MQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 866688 - protein, 255 aa, Homo sapiens
AGPAEGGGFGGVNCAVSAPFSLTCSCASLHLRLCFFSQHCGRDSRVTLAPLVPLVMAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTVFAGHYGNLNA

SEQ ID NO: 866689 - protein, 190 aa, Homo sapiens
AGPAEGGGFGGVNCAVSAPFSLTCSCASLHLRLCFFSQHCGRDSRVTLAPLVPLVMAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNACCVKPLVLWVIG

SEQ ID NO: 866690 - protein, 213 aa, Homo sapiens
AGPAEGGGFGGVNCAVSAPFSLTCSCASLHLRLCFFSQHCGRDSRVTLAPLVPLVMAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGKNINIL

SEQ ID NO: 866691 - protein, 272 aa, Homo sapiens; identical to SEQ ID NO: 866684

SEQ ID NO: 866692 - protein, 196 aa, Homo sapiens [sequence omitted]

SEQ ID NO: 866693 - protein, 196 aa, Homo sapiens [sequence omitted]

SEQ ID NO: 866694 - protein, 117 aa, Homo sapiens
AGPAEGGGFGGVNCAVSAPFSLTCSCASLHLRLCFFSQHCGRDSRVTLAPLVPLVMAYPGYGGGSQCQKQAQLYSSMDTLGQHIQTLIPQLVTPCILTSVLLLDRMVKWMLKNFRDV

SEQ ID NO: 866695 - protein, 166 aa, Homo sapiens
AGPAEGGGFGGVNCAVSAPFSLTCSCASLHLRLCFFSQHCGRDSRVTLAPLVPLVMAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDVSLNRNRKY

SEQ ID NO: 866696 - protein, 906 aa, Homo sapiens
MQTQAGSHCGLWLREMEPSLGQGMDLTCPFGVSPACGAQASWSIFGADAAEVPGTRGHSQQEAAMPHIPEDEEPPGEHRQPRALPAKGPPTAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRATHLQSPPRQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 866697 - protein, 842 aa, Homo sapiens
MVKAPQSEGRLARGGKENNSAFRGPPTAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPEGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 866698 - protein, 947 aa, Homo sapiens
MVKAPQSEGRLARGGKENNSVLDRVSHCHPGWSAVVQPHLPGSSNSHASASQVAGITACGAQASWSIFGADAAEVPGTRGHSQQEAAMPHIPEDEEPPGEHRQPRALPAKGPPTAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 866699 - protein, 849 aa, Homo sapiens
MKLVLESVWINRGPPTAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 866700 - protein, 906 aa, Homo sapiens; identical to SEQ ID NO: 866696

SEQ ID NO: 866701 - protein, 906 aa, Homo sapiens; identical to SEQ ID NO: 866696

SEQ ID NO: 866702 - protein, 906 aa, Homo sapiens; identical to SEQ ID NO: 866696

SEQ ID NO: 866703 - protein, 175 aa, Homo sapiens
MVKAPQSEGRLARGGKENNSVLDRVSHCHPGWSAVVQPHLPGSSNSHASASQVAGITACGAQASWSIFGADAAEVPGTRGHSQQEAAMPHIPEDEEPPGEPQAAQSPAGQGSSYRRSILQSNSHDCPDWGCHFTRRRNRQKPGQQSSQSPQEAFSPTLEGVHCLPDICGPRGAHH

SEQ ID NO: 866704 - protein, 243 aa, Homo sapiens
MAGKRSGWSRAALLQLLLGVNLVVMPPTQARSLRFVTLEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGEVPGWGSIKGKKPWNPL

SEQ ID NO: 866705 - protein, 406 aa, Homo sapiens
MAGKRSGWSRAALLQLLLGVNLVVMPPTQARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTVLLLTVLFRMQAQPPGYRHVADGEDHA

SEQ ID NO: 866706 - protein, 423 aa, Homo sapiens [sequence omitted]

SEQ ID NO: 866707 - protein, 451 aa, Homo sapiens
MAGKRSGWSRAALLQLLLGVNLVVMPPTQARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEAPSHYGKRAAPWRGWPRPGALTCLCDTQQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 866708 - protein, 221 aa, Homo sapiens
MAGKRSGWSRAALLQLLLGVNLVVMPPTQARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEVSPLGCPL

SEQ ID NO: 866709 - protein, 401 aa, Homo sapiens
MAGKRSGWSRAALLQLLLGVNLVVMPPTQARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRSRTETLIHFSEQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 866710 - protein, 221 aa, Homo sapiens
MAGKRSGWSRAALLQLLLGVNLVVMPPTQARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEVVSWKRKF

SEQ ID NO: 866711 - protein, 221 aa, Homo sapiens; identical to SEQ ID NO: 866710

SEQ ID NO: 866712 - protein, 281 aa, Homo sapiens
MAGKRSGWSRAALLQLLLGVNLVVMPPTQARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPENE

SEQ ID NO: 866713 - protein, 423 aa, Homo sapiens [sequence omitted]

SEQ ID NO: 866714 - protein, 423 aa, Homo sapiens [sequence omitted]

SEQ ID NO: 866715 - protein, 423 aa, Homo sapiens [sequence omitted]

SEQ ID NO: 866716 - protein, 423 aa, Homo sapiens [sequence omitted]

SEQ ID NO: 866717 - protein, 198 aa, Homo sapiens
MAGKRSGWSRAALLQLLLGVNLVVMPPTQARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDL

SEQ ID NO: 866718 - protein, 195 aa, Homo sapiens [sequence omitted]

SEQ ID NO: 866719 - protein, 397 aa, Homo sapiens
MAGKRSGWSRAALLQLLLGVNLVVMPPTQARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 866720 - protein, 217 aa, Homo sapiens
MSNPFLKQVFNKDKTFRPKRKFEPGTQRFELHKKAQASLNAGLDLRLAVQLPPGEDLNDWVAVHVVDFFNRVNLIYGTISDGCTEQSCPVMSGGPKYEYRWQDEHKFRKPTALSAPRYMDLLMDWIEAQINNEDLFPTNVGTPFPKNFLQTVRKILSRLFRVFVHVYIHHFDRIAQMGSEAHVNTCYKHFYYFVKEFGLIDTKELEPLKEMTARMCH

SEQ ID NO: 866721 - protein, 227 aa, Homo sapiens
MSNPFLKQVFNKDKTFRPKRKFEPGTQRFELHKKAQASLNAGLDLRLAVQLPPGEDLNDWVAVHVVDFFNRVNLIYGTISDGCTEQSCPVMSGGPKYEYRWQDEHKFRKPTALSAPRYMDLLMDWIEAQINNEDLFPTNVFDRIAQMGSEAHVNTCYKHFYYFVKEFGLIDTKELEPLVRGLGAEGVRLRWGWWPVAEEPFRGQDPDCLRSAQQLAAPAGVGPRGPC

SEQ ID NO: 866722 - protein, 217 aa, Homo sapiens; identical to SEQ ID NO: 866720

SEQ ID NO: 866723 - protein, 217 aa, Homo sapiens; identical to SEQ ID NO: 866720

SEQ ID NO: 866724 - protein, 87 aa, Homo sapiens
KDPLLEKEPERPPQEVREPAQKRRSPGGRAILRSHDGASQHASKQASSVPLDPHLLRPAAYKKDYILRPYPLKFFPHPKQKISGSKV

SEQ ID NO: 866725 - protein, 146 aa, Homo sapiens
MLSLAKRVISRERVIPRERVISRERVIPGERVDPSRNVLSLDERVIPQRNVLSLGERVIPRERVIPRERVIPRERVISRERVIPRNVLSISSRQGRAETDSEAPWTITDAELRVTLTVEGSAIRTIELLHSDRHSHLWEKGNVSSA

SEQ ID NO: 866726 - protein, 134 aa, Homo sapiens
AWPQYKLDNGSKWPENGTFDFSILQDLDHFCQKMGTWSEVPCVQAFFTLRSLPSLCSQCDSSQIFLLSLPSVPSVSTPTSESPESPFSADPSDLSPPPQATPWQAESSPNSSSASAPPSYNSSITSPPQTWSGL

SEQ ID NO: 866727 - protein, 121 aa, Homo sapiens
MGPVPHIWQPDQHPGQHKDLQSELLNFSIQTATHTYGKRVMYHRLSNREYYSYDGKWGQKALVHKTLFLPWPKNSSPPTLKLICLITVFRELILLGQFQAQKYANWHLVSYIKMHPRPETY

SEQ ID NO: 866728 - protein, 2019 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866729 - protein, 1838 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866730 - protein, 2025 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMGLPISMYGGTIIPSHPQLADVPGGPLFNGLHNPDPAWNPMIKVIQNSTECTDAQQIWPGTWAPHIGNMHLKYVN

SEQ ID NO: 866731 - protein, 2017 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 866732 - protein, 1975 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 866733 - protein, 2109 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQASLLPSVPALKGEIPSPQLTRPKKRIGRPMVASPNQRHQDHLRPKVPAGVQELTHCPDTPLLPPSDSRGHNSSNSPSLQAGGAEGAGDRGRDTR

SEQ ID NO: 866734 - protein, 2092 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQASLLPSVPALKGEIPSPQLTRPKKRIGRPMVASPNQRHQDHLRPKVPAGVQELTHCPDTPLLPPSDSRGHNSSNSPSLQAGGAEGAGDRGRDTR

SEQ ID NO: 866735 - protein, 1987 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866736 - protein, 1313 aa, Homo sapiens
YRRPTRPILTYLWDLKIKTMELLDTDSRRIVTRGWEGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866737 - protein, 1286 aa, Homo sapiens
ALTIAASLEEGTGGSINICSFIKKNSSNLCIPSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866738 - protein, 1811 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLGVSTSPVGLPSIDPSGSSPSSSSAPLASFSGIPGTRVFLQGPAPVGTPSFNRQHFSPHPWTSASNSCRNPGGTLPKEF

SEQ ID NO: 866739 - protein, 1243 aa, Homo sapiens
FVGTKGIPHLVTHDARTTRYPDPLIKVNDTIQIDLETGKITDFIKFDTGNLCMVTGGGSPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866740 - protein, 1182 aa, Homo sapiens
MSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866741 - protein, 1622 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPATLYRADVNAQSSRLCGKCKRHDIRPKSDTLDGCASFVCYWKEEWDYWMGEF

SEQ ID NO: 866742 - protein, 956 aa, Homo sapiens
MATDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866743 - protein, 966 aa, Homo sapiens
ELLLLAFFSLLFMLQCASAEAHCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866744 - protein, 962 aa, Homo sapiens
STGPRAESLLQCASRKQHCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866745 - protein, 1326 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTTPLRLEQTISLTFVQLLSTLLLLSDPF

SEQ ID NO: 866746 - protein, 1220 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVKIKGQARWLTPIIPALWEAEV

SEQ ID NO: 866747 - protein, 1017 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEEKRHSKTKRSLGLSAVPVGEVTVTSGPPPSIPYAGAAAPPLPLPGPHTDGHSEKKKKTEEKDKERER

SEQ ID NO: 866748 - protein, 220 aa, Homo sapiens
GCVDLEDPGKLLVASNGGHFDVVQLLVQAGADVDAADNRKITPLMSAFRKGHVKVVQYLVKEVNQFPSDIECMRYIATITDKNGGKNVINVSETMVTAQKLLKLISKFSKAEDTKSMCKNHKHSYTPAIDNILQFLYTNNRQESQIMNGLPFTMVTKRIKYLGIQLMMGVKNLFKENYKPLLKEIREDTTNGKYSSSWWEDQSHENGILPSNIDSGYPSI

SEQ ID NO: 866749 - protein, 1807 aa, Homo sapiens
MALFQTFFMCLGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866750 - protein, 1766 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866751 - protein, 2034 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 866752 - protein, 1769 aa, Homo sapiens
KAGADIELGCSTPLMEASQEGHLELVKYLLASGANVHATTATGDTALTYACENGHTDVADVLLQAGADLDKQEDMKTILEGIDPAKHQEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQEPDRTSQENSPALLGVQKAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866753 - protein, 1507 aa, Homo sapiens
MPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866754 - protein, 2034 aa, Homo sapiens; identical to SEQ ID NO: 866751

SEQ ID NO: 866755 - protein, 1659 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLWEAEVGGSLEVRSLRPV

SEQ ID NO: 866756 - protein, 1829 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCRNPGGTLPKEF

SEQ ID NO: 866757 - protein, 1828 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSCLAGLPKVSEERFRLTSESTNQRVLWWSIAQTVILILTGIWQMRHLKSFFEAKKLV

SEQ ID NO: 866758 - protein, 979 aa, Homo sapiens
MSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866759 - protein, 1169 aa, Homo sapiens
RPRGPPSSSYLPPSSYLPIATITDEELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 866760 - protein, 1564 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTLDGCALVLERGR

SEQ ID NO: 866761 - protein, 988 aa, Homo sapiens
KAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVGARSSHRPPSAPKSV

SEQ ID NO: 866762 - protein, 508 aa, Homo sapiens
VAEPSAYGGRDVACASLVFGRLQHRGGDRKRGLLGRSSGDAASDQPFRCRSGSTADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 866763 - protein, 211 aa, Homo sapiens
MDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSDMWSQSPNLK

SEQ ID NO: 866764 - protein, 360 aa, Homo sapiens
VAEPSAYGGRDVACASLVFGRLQHRGGDRKRGLLGRSSGDAASDQPFRCRSGSTADWSNKWILQRLTRTRALQLDLLAGWLAGWLAAGWLAGWLAGCWLAGWLAGWLLAGWLAGWLAAGWLAGWLAGCWLAGWLAGWLLAGWLAGWLAAGWLAGWLAGCWLAGWLAGWLLAGWLAGWLAAGWLAGWLAGCWLAGWLAGWLLAGWLAGWLAAGWLAGWLAGCWLAGWLAGWLLAGWLAGWLAAGWLAGWLAGCWLAGWLAGWLLAGWLAGWLAAGWLAGWLAGCMAWHGMAWHGMAVHGMAWHGMAWHGMPGLAWPGLAWPGLPGLAWPGLAWPGLLAWPGLAWPGLACLAWPGLAWPGLA

SEQ ID NO: 866765 - protein, 556 aa, Homo sapiens
MAMMPLVLHHPERQAELGSGLRDGGGAALRPPGRLVKQMDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 866766 - protein, 473 aa, Homo sapiens
VKPLGILTLCSGEEPGLFSSYSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 866767 - protein, 445 aa, Homo sapiens
MKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 866768 - protein, 547 aa, Homo sapiens [sequence omitted]

SEQ ID NO: 866769 - protein, 411 aa, Homo sapiens
MEEGRRCGHPAAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 866770 - protein, 518 aa, Homo sapiens
MDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 866771 - protein, 85 aa, Homo sapiens
VAEPSAYGGRDVACASLVFGRLQHRGGDRKRGLLGRSSGDAASDQPFRCRSGSTADWSNKWILQRLTRTRALQLDLLPGKAMLKS

SEQ ID NO: 866772 - protein, 352 aa, Homo sapiens
MALPFRKDLEKYKDLDEDELLGNLSETELKQLETVLDDLDPENALLPAGFRQKNQTSKSTTGPFDREHLLSYLEKEALEHKDREDYVPYTGEKKGKIFIPKQKPVQTFTEEKVSLDPELEEALTSASDTELCDLAAILGMHNLITNTKFCNIMGSSNGVDQEHFSNVVKGEKILPVFDEPPNPTNVEESLKRTKENDAHLVEVNLNNIKNIPIPTLKDFAKALETNTHVKCFSLAATRSNDPVATAFAEMLKVNKTLKSLNVESNFITGVGILALIDALRDNETLAELKIDNQRQQLGTAVELEMAKMLEENTNILKFGYQFTQQGPRTRAANAITKNNDLVRKRRVEGDHQ

SEQ ID NO: 866773 - protein, 352 aa, Homo sapiens; identical to SEQ ID NO: 866772

SEQ ID NO: 866774 - protein, 205 aa, Homo sapiens
RVWLPSEKKYGVDQEHISNVVKGEKILPVFDEPPNPTNVEESLKRTKENDAHLVEVNLNNIKNIPIPTLKDFAKALETNTHVKCFSLAATRSNDPVATAFAEMLKVNKTLKSLNVESNFITGVGILALIDALRDNETLAELKIDNQRQQLGTAVELEMAKMLEENTNILKFGYQFTQQGPRTRAANAITKNNDLVRKRRVEGDHQ

SEQ ID NO: 866775 - protein, 352 aa, Homo sapiens; identical to SEQ ID NO: 866772

SEQ ID NO: 866776 - protein, 300 aa, Homo sapiens
MALPFRKDLEKYKDLDEDELLGNLSETELKQLETVLDDLDPENALLPAGFRQKNQTSKSTTGPFDREHLLSYLEKEALEHKDREDYVPYTGEKKGKIFIPKQKPVQTFTEEKVSLDPELEEALTSASDTELCDLAAILGMHNLITNTKFCNIMGSSNGVDQEHFSNVVKGEKILPVFDEPPNPTNVEESLKRTKENDAHLVEVNLNNIKNIPIPTLKDFAKALETNTHVKCFSLAATRSNDPVATAFAEMLKVNKTLKSLNVESNFITGVGILALMGEDCAKIQQQQQQQTKYTWYLGKC

SEQ ID NO: 866777 - protein, 352 aa, Homo sapiens; identical to SEQ ID NO: 866772

SEQ ID NO: 866778 - protein, 352 aa, Homo sapiens; identical to SEQ ID NO: 866772

SEQ ID NO: 866779 - protein, 352 aa, Homo sapiens; identical to SEQ ID NO: 866772

SEQ ID NO: 866780 - protein, 111 aa, Homo sapiens
SGTSHEKALEKEELKMEETRVRTGGYRRRNRSCTTDPPPRFDVPPSLLLSFFFPRICSFLIVLDFIETAQFQQDWESGMEQASQATRKNWSPRLSVRHPRLHCPVSQLVDK

SEQ ID NO: 866781 - protein, 191 aa, Homo sapiens
MALPFRKDLEKYKDLDEDELLGNLSETELKQLETVLDDLDPENALLPAGFRQKNQTSKSTTGPFDREHLLSYLEKEALEHKDREDYVPYTGEKKGKIFIPKQKPVQTFTEEKVSLDPELEEALTSASDTELCDLAAILGMHNLITNTKFCNIMGSSNSLCCNSLCCNSLCCNSLCCNSLCCNSLCCNSLCC

SEQ ID NO: 866782 - protein, 536 aa, Homo sapiens
MLSFSLAAPKIKTADQDLVVDVGKPLTMVVPYDAYPKAEAEWFKENEPLSTKTIDTTAEQTSFRILEAKKGDKGRYKIVLQNKHGKAEGFINLKVIGKPLGLSDLIGKAQFKSKTAHSKNSSICEFQMFLGQYVDLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFGVEPTMDLSAFKDGLEVIVPNPITILVPSTGYPRPTATWCFGDKVLETGDRVKMKTLSAYAELVISPSERSDKGIYTLKLENRVKTISGEIDVNVIGKEQNIYHLR

SEQ ID NO: 866783 - protein, 151 aa, Homo sapiens
PPLLTATQLHLQPETWVSIFALPRAIVLAIHQRPGQVFTSLCWMGWPSRLCTVRCCRRSCEDTFFLTSQHRNVSRPVHVPVLVLLSAPSTLPHGGLLHARGCQYQTRAASAFSQFQPLLSTYLPSISTGCLPVILHSTRLTIYFQPALQFP

SEQ ID NO: 866784 - protein, 240 aa, Homo sapiens
MEQTWTRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDKI

SEQ ID NO: 866785 - protein, 111 aa, Homo sapiens
TDAVAGPDSEDTHPMCRSWGGKSCCLLRWRFVGKASHFPRLLPLPGEERPETKERAWKMEQTWTRDYFAEDDGERHMRLPLMFFSFRFILVFFSIDGLYAHCQARNPALVA

SEQ ID NO: 866786 - protein, 279 aa, Homo sapiens
MEQTWTRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQL

SEQ ID NO: 866787 - protein, 203 aa, Homo sapiens
MEQTWTRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNTELKVEVESLKRELQDKKQHLDKTWADVENLNSQNEAELRRQFEERQQETEHVYELLENKMQLLQEEFRPSKRMKTFSGWGTFWLERQK

SEQ ID NO: 866788 - protein, 206 aa, Homo sapiens
LQLGLGGSRRVTAESWLGVGLHHLCLSSRSMFLCQGFRKYLPEHLNDLKKENFSLKLRIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDK

SEQ ID NO: 866789 - protein, 42 aa, Homo sapiens
MEQTWTRDYFAEDDGERHMRWGILKSRGAYCCSQSVRKPIIS

SEQ ID NO: 866790 - protein, 173 aa, Homo sapiens
MSNGYRTLSQHLNDLKKENFSLKLRIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDK

SEQ ID NO: 866791 - protein, 219 aa, Homo sapiens
MKGTDSGSCCRRRCDFGCCCRASRRAHYTPYRSGDATRTPQSPRQTPSRERRRPEPAGSWAAAAEEEEAAAAATPWMRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRQLPTQTLGPADFGGLQLNLHLLLEWSSLCKRGWWK

SEQ ID NO: 866792 - protein, 239 aa, Homo sapiens
MEQTWTRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDK

SEQ ID NO: 866793 - protein, 313 aa, Homo sapiens
MEQTWTRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEK

SEQ ID NO: 866794 - protein, 310 aa, Homo sapiens
MKGTDSGSCCRRRCDFGCCCRASRRAHYTPYRSGDATRTPQSPRQTPSRERRRPEPAGSWAAAAEEEEAAAAATPWMRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDK

SEQ ID NO: 866795 - protein, 179 aa, Homo sapiens
CLESQHFGRPRRADLKHLNDLKKENFSLKLRIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDK

SEQ ID NO: 866796 - protein, 150 aa, Homo sapiens
MILAHGKLRLPGSSDSPASASRVAGITGMCHHAPLARLVSNTLPQVILPPLGLQQAEELPRRQEVEQNTPSLVPIIDNIMELTQRKKTASTPCDFIPNQSALLAHWLPPTHQIVLKNSALQTLGETDLSNNKTLVSCKNKNNGLLRLTAE

SEQ ID NO: 866797 - protein, 176 aa, Homo sapiens
MASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 866798 - protein, 176 aa, Homo sapiens; identical to SEQ ID NO: 866797

SEQ ID NO: 866799 - protein, 176 aa, Homo sapiens; identical to SEQ ID NO: 866797

SEQ ID NO: 866800 - protein, 176 aa, Homo sapiens; identical to SEQ ID NO: 866797

SEQ ID NO: 866801 - protein, 176 aa, Homo sapiens; identical to SEQ ID NO: 866797

SEQ ID NO: 866802 - protein, 107 aa, Homo sapiens
PARHVTPAPTWAEEPPRPLAESPRQIPSVAAKMMCGAPSATQPATAETQHIADQVRSQLEEKENKKFPVFKAVSFKSQVVAGTNYFIKGARRRRGLRTPASVPISPS

SEQ ID NO: 866803 - protein, 107 aa, Homo sapiens; identical to SEQ ID NO: 866802

SEQ ID NO: 866804 - protein, 115 aa, Homo sapiens
PARHVTPAPTWAEEPPRPLAESPRQIPSVAAKMMCGAPSATQPATAETQHIADQVRSQLEEKENKKFPVFKAVSFKSQVVAGTNYFIKVECGPQEGLPRTGAGRKPPVQARAVWS

SEQ ID NO: 866805 - protein, 108 aa, Homo sapiens
PARHVTPAPTWAEEPPRPLAESPRQIPSVAAKMMCGAPSATQPATAETQHIADQVRSQLEEKENKKVHVGDEDFVHLRVFQSLPHENKPLTLSNYQTNKAKHDELTYF

SEQ ID NO: 866806 - protein, 115 aa, Homo sapiens; identical to SEQ ID NO: 866804

SEQ ID NO: 866807 - protein, 107 aa, Homo sapiens; identical to SEQ ID NO: 866802

SEQ ID NO: 866808 - protein, 107 aa, Homo sapiens; identical to SEQ ID NO: 866802

SEQ ID NO: 866809 - protein, 107 aa, Homo sapiens; identical to SEQ ID NO: 866802

SEQ ID NO: 866810 - protein, 107 aa, Homo sapiens; identical to SEQ ID NO: 866802

SEQ ID NO: 866811 - protein, 115 aa, Homo sapiens; identical to SEQ ID NO: 866804

SEQ ID NO: 866812 - protein, 577 aa, Homo sapiens [sequence omitted]

SEQ ID NO: 866813 - protein, 648 aa, Homo sapiens
MHGFAVFQELVTFRDVAIDFSRQEWEYLDPNQRDLYRDVMLENYRNLVSLGGHSISKPVVVDLLERGKEPWMILREETQFTDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGVKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 866814 - protein, 135 aa, Homo sapiens
GQPRVRIPLLSLLGSLKPSELRGQVGHAFASAIFASAISLCVFTLLVEGKLKPPGASVRRCLQSNRDLGFRATFPTSHRGHGALGLNYISQRATGTPNLWLPFRFRVVLLQVSGISDIQGCGHRLLSAGVGIPGP

SEQ ID NO: 866815 - protein, 784 aa, Homo sapiens
GQPRVRIPLLSLLGSLKPSELRGQVGHAFASAIFASAISLCVFTLLVEGKLKPPGASVRRCLQSNRDLGFRATFPTSHRGHGALGLNYISQRATGTPNLWLPFRFRVVLLQALDSLEFECFQYWNPTKYGLIRSYNSKTMTCFQELVTFRDVAIDFSRQEWEYLDPNQRDLYRDVMLENYRNLVSLGGHSISKPVVVDLLERGKEPWMILREETQFTDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGVKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 866816 - protein, 600 aa, Homo sapiens
RLECSGLISAHCNLYLPRSSDSPASASRVAGITDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGVKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 866817 - protein, 608 aa, Homo sapiens
HTWLIFVFLVEMGFHHVGQAGLELLTSGDPPTSASESAGITDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGVKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 866818 - protein, 305 aa, Homo sapiens
VTSGVRPGSRPLPRRRSCRPMAGGWAQGSRRAARLPEGGRLMAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 866819 - protein, 275 aa, Homo sapiens
VTSGVRPGSRPLPRRRSCRPMAGGWAQGSRRAARLPEGGRLMAPASRLLALWALAAVALPGSGAEGDGGWYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 866820 - protein, 332 aa, Homo sapiens
RSLPGSVPVPGRCHDDEAAGQWLADGPKVPGVQRGCLRAAGSWRRRRGCSRSGRWRLWLYPAPGRRATAGGERPGRGRAVGSRAAGGARADPAVPSRRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 866821 - protein, 341 aa, Homo sapiens
VTSGVRPGSRPLPRRRSCRPMAGGWAQGSRRAARLPEGGRLMAPASRLLALWALAAVALPGSGAEGDGGWRPGGPGAVAEEERCTVERRADLTYAEFVQQYVLPLIAEVASCSPARLPRPPKAAFPGPRAHAWGWGGEAGGPAWPRLCPSFQRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 866822 - protein, 126 aa, Homo sapiens
VTSGVRPGSRPLPRRRSCRPMAGGWAQGSRRAARLPEGGRLMAPASRLLALWALAAVALPGSGAEGDGGWRPGGPGAVAEEERCTVERRADLTYAEFVQQYVLPLIAEVASCSPARLPRPPKAAFP

SEQ ID NO: 866823 - protein, 216 aa, Homo sapiens
RSLPGSVPVPGRCHDDEAAGQWLADGPKVPGVQRGCLRAAGSWRRRRGCSRSGRWRLWLYPAPGRRATAGGERPGRGRAVGSRAAGGARADPAVPAGARAGRGPWRRRSAARWSVGPTSPTRSSCSSTCAPDRGGRVLFTGPSAPTAQGRLPLTSRARVGLGRRGWRSGLAATLPFFPGTPSSGPSSCRDSRTTRGSGPCAPATGCWLRLGTEWSG

SEQ ID NO: 866824 - protein, 387 aa, Homo sapiens
VTSGVRPGSRPLPRRRSCRPMAGGWAQGSRRAARLPEGGRLMAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGERSVAGRRGPGQARGPQLISAAPPSSTRCCTSPTAGGMLRSTLTPASSSPPSSASQNSWQDCRSHTSTSHLVLTDFITQIVAAMASAQPTLTCFSSPQRGTITAQQKRC

SEQ ID NO: 866825 - protein, 386 aa, Homo sapiens
VTSGVRPGSRPLPRRRSCRPMAGGWAQGSRRAARLPEGGRLMAPASRLLALWALAAVALPGSGAEGDGGWRPGGPGAVAEEERCTVERRADLTYAEFVQQYAFVRPVILQGLTDNSVSACPSVPGHSRPCWARPLSPLPAPAEVPGPVLPRQVAGFVWGQSGPAEHRQHLLLPQRYAASPLGPAHLPTPGRLDQTVLTRLFPAVDLPFQEYVEQLLHPQDPTSLGNDTLYFFGDNNFTEWASLFRHYSPPPFGLLGTAPAYSFGIAGAGSGVPFHWHGPGYSEVIYGRKVSSGVGVEAWDSLTKTGKGELLLMPQRWFLYPPEKTPEFHPNKTTLAWLRDTYPALPPSARPLECTIRAGEVLYFPDRWWHATLNLDTSVFISTFLG

SEQ ID NO: 866826 - protein, 167 aa, Homo sapiens
VTSGVRPGSRPLPRRRSCRPMAGGWAQGSRRAARLPEGGRLMAPASRLLALWALAAVALPGSGAEGDGGWYAFVRPVILQGLTDNSVSACPSVPGHSRPCWARPLSPLPAPAEVPGPVLPRQVAGFVWGQSGPAEHRQHLLLPQSGLALPGVCGAAAAPPGPHLPGQ

SEQ ID NO: 866827 - protein, 305 aa, Homo sapiens; identical to SEQ ID NO: 866818

SEQ ID NO: 866828 - protein, 305 aa, Homo sapiens; identical to SEQ ID NO: 866818

SEQ ID NO: 866829 - protein, 384 aa, Homo sapiens
RSLPGSVPVPGRCHDDEAAGQWLADGPKVPGVQRGCLRAAGSWRRRRGCSRSGRWRLWLYPAPGRRATAGGERPGRGRAVGSRAAGGARADPAVPAGARAGRGPWRRRSAARWSVGPTSPTRSSCSSTCAPDRGGRVLFTGRVCPDRPRPPSPDLARTRGAGAARLAVRPGRDSALLSRYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 866830 - protein, 197 aa, Homo sapiens
VTSGVRPGSRPLPRRRSCRPMAGGWAQGSRRAARLPEGGRLMAPASRLLALWALAAVALPGSGAEGDGGWRPGGPGAVAEEERCTVERRADLTYAEFVQQYAFVRPVILQGLTDNSVSACPSVPGHSRPCWARPLSPLPAPAEVPGPVLPRQVAGFVWGQSGPAEHRQHLLLPQSGLALPGVCGAAAAPPGPHLPGQ

SEQ ID NO: 866831 - protein, 262 aa, Homo sapiens
VTSGVRPGSRPLPRRRSCRPMAGGWAQGSRRAARLPEGGRLMAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNGEAALGGGRGWGRLESPGARIPVPAVSVGRHPVLLRGQQLHRVGLSLSALLPTPIWPAGNRSSLQLWNRRSWLGGALPLAWTRVLRSDLRS

SEQ ID NO: 866832 - protein, 198 aa, Homo sapiens
VTSGVRPGSRPLPRRRSCRPMAGGWAQGSRRAARLPEGGRLMAPASRLLALWALAAVALPGSGAEGDGGWRPGGPGAVAEEERCTVERRADLTYAEFVQQYAFVRPVILQGLTDNSVSACPSVPGHSRPCWARPLSPLPAPAEVPGPVLPRQVAGFVWGQSGPAEHRQHLLLPQSGLALPGVCGAAAAPPGPHLPGQW

SEQ ID NO: 866833 - protein, 260 aa, Homo sapiens
VTSGVRPGSRPLPRRRSCRPMAGGWAQGSRRAARLPEGGRLMAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKVLYFPDRWWHATLNLDTSVFISTFLG

SEQ ID NO: 866834 - protein, 305 aa, Homo sapiens; identical to SEQ ID NO: 866818

SEQ ID NO: 866835 - protein, 70 aa, Homo sapiens
MTMNVLEAGKWKSIVPAPGEGLLAVLHMMVFTDALHRERSVKWQAGVCYNGGKDFAVSLARPKAAEGIAD

SEQ ID NO: 866836 - protein, 167 aa, Homo sapiens
LHHLVDEEKARCLEGIGGHTRGLVASLDMQLEQAQGTRERLAQAECVLEQFGNEDHHKFIRKFHSMASRAEMPQARPLEGAFSPISFKPGLHQADIKLTVWKRLFRKVLPAPEPLKLDPATAHPLLELSKGNTVVQCGLLAQRRASQPERFDYSTCVLASRGFSCGR

SEQ ID NO: 866837 - protein, 96 aa, Homo sapiens
MPQARPLEGAFSPISFKPGLHQADIKLTVWKRLFRKVLPAPEPLKLDPATAHPLLELSKGNTVVQCGLLAQRRASQPERFDYSTCVLASRGFSCGR

SEQ ID NO: 866838 - protein, 220 aa, Homo sapiens
LHHLVDEEKARCLEGIGGHTRGLVASLDMQLEQAQGTRERLAQAECVLEQFGNEDHHKFIRKFHSMASRAEMPQARPLEGAFSPISFKPGLHQADIKLTVWKRLFRKVLPGSSPVLAPSRPWGKRDEEDTAPLLGEFRASISFCGPGLLPSTWPHRPSVISLPAPEPLKLDPATAHPLLELSKGNTVVQCGLLAQRRASQPERFDYSTCVLASRGFSCGR

SEQ ID NO: 866839 - protein, 110 aa, Homo sapiens
HPGIHLSSSSKIPAWQLRFSHLVGYGARYYSYLMSRAVASMVWKECFLQDPFNRAAGERYRREMLAHGGGREPMLMVEGMLQKCPSVDDFVSALVSDLDLDFETFLMDSE

SEQ ID NO: 866840 - protein, 755 aa, Homo sapiens
TRKRGRHVGRRGLLPWKRGARAPSESSRAGICVGGRDCSGARMLCVGRLGGLGARAAALPPRRAGRGSLEAGIRARRVSTSWSPVGAAFNVKPQGSRLDLFGERRGLFGVPELSAPEGFHIAQEKALRKTELLVDRACSTPPGPQTVLIFDELSDSLCRVADLADFVKIAHPEPAFREAAEEACRSIGTMVEKLNTNVDLYQSLQKLLADKKLVDSLDPETRRVAELFMFDFEISGIHLDKEKRKRAVDLNVKILDLSSTFLMGTNFPNKIEKHLLPEHIRRNFTSAGDHIIIDGLHAESPDDLVREAAYKIFLYPNAGQLKCLEELLSSRDLLAKLVGYSTFSHRALQGTIAKNPETVMQFLEKLSDKLSERTLKDFEMIRGMKMKLNPQNSEVMPWDPPYYSGVIRAERYNIEPSLYCPFFSLGACMEGLNILLNRLLGISLYAEQPAKGEVWSEDVRKLAVVHESEGLLGYIYCDFFQRADKPHQDCHFTIRGGRLKEDGDYQLPVVVLMLNLPRSSRSSPTLLTPGMMENLFHEMGHAMHSMLGRTRYQHVTGTRCPTDFAEVPSILMEYFANDYRVVNQFARHYQTGQPLPKNMVSRLCESKKVCAAADMQLQVFYATLDQIYHGKHPLRNSTTDILKETQEKFYGLPYVPNTAWQLRFSHLVGYGARYYSYLMSRAVASMVWKECFLQDPFNRAAGERYRREMLAHGGGREPMLMVEGMLQKCPSVDDFVSALVSDLDLDFETFLMDSE

SEQ ID NO: 866841 - protein, 755 aa, Homo sapiens; identical to SEQ ID NO: 866840

SEQ ID NO: 866842 - protein, 457 aa, Homo sapiens
TRKRGRHVGRRGLLPWKRGARAPSESSRAGICVGGRDCSGARMLCVGRLGGLGARAAALPPRRAGRGSLEAGIRARRVSTSWSPVGAAFNVKPQGSRLDLFGERRGLFGVPELSAPEGFHIAQEKALRKTELLVDRACSTPPGPQTVLIFDELSDSLCRVADLADFVKIAHPEPAFREAAEEACRSIGTMVEKLNTNVDLYQSLQKLLADKKLVDSLDPETRRVAELFMFDFEISGIHLDKEKRKRAVDLNVKILDLSSTFLMGTNFPNKIEKHLLPEHIRRNFTSAGDHIIIDGLHAESPDDLVREAAYKIFLYPNAGQLKCLEELLSSRDLLAKLVGYSTFSHRALQGTIAKNPETVMQFLEKLSDKLSERTLKDFEMIRGMKMKLNPQNSEVMPWDPPYYSGVIRAERYNIEPSLYCPFFSLGACMEGLNILLNRLLGISLYVCFRSVLLLMTS

SEQ ID NO: 866843 - protein, 755 aa, Homo sapiens; identical to SEQ ID NO: 866840

SEQ ID NO: 866844 - protein, 651 aa, Homo sapiens [sequence omitted]

SEQ ID NO: 866845 - protein, 287 aa, Homo sapiens
NIYTITITSIIQNKIQEESLDCHFTIRGGRLKEDGDYQLPVVVLMLNLPRSSRSSPTLLTPGMMENLFHEMGHAMHSMLGRTRYQHVTGTRCPTDFAEVPSILMEYFANDYRVVNQFARHYQTGQPLPKNMVSRLCESKKVCAAADMQLQVFYATLDQIYHGKHPLRNSTTDILKETQEKFYGLPYVPNTAWQLRFSHLVGYGARYYSYLMSRAVASMVWKECFLQDPFNRAAGERYRREMLAHGGGREPMLMVEGMLQKCPSVDDFVSALVSDLDLDFETFLMDSE

SEQ ID NO: 866846 - protein, 600 aa, Homo sapiens
TRKRGRHVGRRGLLPWKRGARAPSESSRAGICVGGRDCSGARMLCVGRLGGLGARAAALPPRRAGRGSLEAGIRARRVSTSWSPVGAAFNVKPQGSRLDLFGERRGLFGVPELSAPEGFHIAQEKALRKTELLVDRACSTPPGPQTVLIFDELSDSLCRVADLADFVKIAHPEPAFREAAEEACRSIGTMVEKLNTNVDLYQSLQKLLADKKLVDSLDPETRRVAELFMFDFEISGIHLDKEKRKRAVDLNVKILDLSSTFLMGTNFPNKIEKHLLPEHIRRNFTSAGDHIIIDGLHAESPDDLVREAAYKIFLYPNAGQLKCLEELLSSRDLLAKLVGYSTFSHRALQGTIAKNPETVMQFLEKLSDKLSERTLKDFEMIRGMKMKLNPQNSEVMPWDPPYYSGVIRAERYNIEPSLYCPFFSLGACMEGLNILLNRLLGISLYAEQPAKGEVWSEDVRKLAVVHESEGLLGYIYCDFFQRADKPHQDCHFTIRGGRLKEDGDYQLPVVVLMLNLPRSSRSSPTLLTPGMMENLFHEMGHAMHSMLGRTRYQHVTGTRCPTDFAEVPSILMEYFANDYRVVNQFARHYQTGQVGTVILS

SEQ ID NO: 866847 - protein, 271 aa, Homo sapiens
MNRTWPRRIWGSSQDEAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGGKGHPGVGSEPPPDLFQMSPLSPGSPLPPLARADLTAILTGCSPLSACLVLARVPSPRPSAPLRGLADAAGQPPSEAEYTDVLQKIKYAFSLAGEDAP

SEQ ID NO: 866848 - protein, 207 aa, Homo sapiens
MGNHVKGTQTSLLVIYTNEFLQGTHPQNASKAQRPEPVGTSSNADSASPDLGPRGPDLAVLQAEREVDILNHVFDDVESFVSRLQKSAEAARVLEHRERGRRSRRRAAGGKGHPGVGSEPPPDLFQMSPLSPGSPLPPLARADLTAILTGCSPLSACLVLARVPSPRPSAPLRGLADAAGQPPSEAEYTDVLQKIKYAFSLAGEDAP

SEQ ID NO: 866849 - protein, 380 aa, Homo sapiens
MGRKAIVLAIANTSLAFPLCQHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGGKGHPGVGSEPPPDLFQMSPLSPGSPLPPLARADLTAILTGCSPLSACLVLARVPSPRPSAPLRGLADAAGQAALGGEYTDVLQKIKYAFSLAGEDAP

SEQ ID NO: 866850 - protein, 334 aa, Homo sapiens
MDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGGKGHPGVGSEPPPDLFQMSPLSPGSPLPPLARADLTAILTGCSPLSACLVLARVPSPRPSAPLRGLADAAGQPPSEAEYTDVLQKIKYAFSLAGEDAP

SEQ ID NO: 866851 - protein, 491 aa, Homo sapiens
MSTATGPEAAPKPSAKSIYEQRKRYSTVVMADVSQYPVNHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVVSRKEGVWGQGQATGGGARAWKGGAGCGTGVLWSDFCVMEEGLGRGRGLVVGRGQVFGAWPDLGKCIGAQVQGFDGDGFGTREPWRPPPLSPEDILNHVFDDVESFVSRLQKSAEAARVLEHRERGRRSRRRAAGGKGHPGVGSEPPPDLFQMSPLSPGSPLPPLARADLTAILTGCSPLSACLVLARVPSPRPSAPLRGLADAAGQPPSEAEYTDVLQKIKYAFSLAGEDAP

SEQ ID NO: 866852 - protein, 398 aa, Homo sapiens
MSTATGPEAAPKPSAKSIYEQRKRYSTVVMADVSQYPVNHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGGKGHPGVGSEPPPDLFQMSPLSPGSPLPPLARADLTAILTGCSPLSACLVLARVPSPRPSAPLRGLADAAGQPPSEAEYTDVLQKIKYAFSLAGEDAP

SEQ ID NO: 866853 - protein, 61 aa, Homo sapiens
MQVILLEKVGAQAPENNPNIQRNRPPPTFPEGGRCTSRSVRGCPRGTTLLFLPKEGRPECV

SEQ ID NO: 866854 - protein, 259 aa, Homo sapiens
LSRQAQVQAVQLGRPSGSCRGGRAQLQEGVQKPQAMAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVRSQARLRVQVPAVRSAPVVRARASGDLPARPGDHPAEERCQVEGGLPHILQLPARRPLHLVSARRRGHSLLGRLVRPEGHQQQHHHRAPAALTPPEPPSAEP

SEQ ID NO: 866855 - protein, 224 aa, Homo sapiens
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVRSQARLRVQVPAVRSAPVVRARASGDLPARPGDHPAEERCQVEGGLPHILQLPARRPLHLVSARRRGHSLLGRLVRPEGHQQQHHHRAPAALTPPEPPSAEP

SEQ ID NO: 866856 - protein, 255 aa, Homo sapiens
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVKKYFVTSYYTCLKSQVVDLKAEGYWEELMDTTRPDIEVKDWFAARPDCGSKYQLCVQLLSSAHAPLGTFQPDPATIQQKSDAKWREVSHTFSNYPPGVRYIWFQHGGVDTHYWAGWYGPRVTNSSITIGPPLP

SEQ ID NO: 866857 - protein, 165 aa, Homo sapiens
LSRQAQVQAVQLGRPSGSCRGGRAQLQEGVQKPQAMAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVKKYFVTSY

SEQ ID NO: 866858 - protein, 290 aa, Homo sapiens
LSRQAQVQAVQLGRPSGSCRGGRAQLQEGVQKPQAMAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVKKYFVTSYYTCLKSQVVDLKAEGYWEELMDTTRPDIEVKDWFAARPDCGSKYQLCVQLLSSAHAPLGTFQPDPATIQQKSDAKWREVSHTFSNYPPGVRYIWFQHGGVDTHYWAGWYGPRVTNSSITIGPPLP

SEQ ID NO: 866859 - protein, 174 aa, Homo sapiens [sequence omitted]

SEQ ID NO: 866860 - protein, 113 aa, Homo sapiens
AEGGLAPTRPRPPSLPGLRCAAANGGWGRHRCTGVRAQTLGGILRHSVGRGGCRRAGGLGAGGAQPRGWGWEWGWGDRKGPSLSPTLLPLPPRQEIMSSEILRRWLEPFGPPR

SEQ ID NO: 866861 - protein, 259 aa, Homo sapiens; identical to SEQ ID NO: 866854

SEQ ID NO: 866862 - protein, 224 aa, Homo sapiens; identical to SEQ ID NO: 866855

SEQ ID NO: 866863 - protein, 290 aa, Homo sapiens; identical to SEQ ID NO: 866858

SEQ ID NO: 866864 - protein, 259 aa, Homo sapiens; identical to SEQ ID NO: 866854

SEQ ID NO: 866865 - protein, 130 aa, Homo sapiens
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVKKYFVTSY

SEQ ID NO: 866866 - protein, 162 aa, Homo sapiens
LVRSGMYGILGGQRIVAAAAERLQEGVQKPQAMAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVKKYFVTSY

SEQ ID NO: 866867 - protein, 226 aa, Homo sapiens
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVKKYFVTSYYTCLKSQVVDLKAEGYWEELMDTTRPDIEVKDWFAARPDCGSKYQLCVQLLSSAHAPLGTFQPDPATIQQKSDAKWRESPKFSNYRRVRSSRAELD

SEQ ID NO: 866868 - protein, 127 aa, Homo sapiens
RLRPRLAAVGPTGSYNYFFPLLLTHLEELVLPREAHGARNEAKGRGPSRGIPLYRQRLRRPGPRSEAGAQRGGQLHHPGRGRAQPVGHRPRAEPDVTSRSLPPPSGAARGLWLRDCGEHIVMFVPQS

SEQ ID NO: 866869 - protein, 913 aa, Homo sapiens
MSEFRIHHDVNELLSLLRVHGGDGAEVYIDLLQKNRTPYVTTTVSAHSAKVSTALGVALCRVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 866870 - protein, 701 aa, Homo sapiens
MGFTGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 866871 - protein, 786 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVA

SEQ ID NO: 866872 - protein, 724 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWCVLPLPPHALLKQRSLHSAQVVQRPPCALLVDSFLGFWKVSSGSARWWL

SEQ ID NO: 866873 - protein, 541 aa, Homo sapiens
MSGAVDRTSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 866874 - protein, 664 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKLLRVLAIETKQEKAMAHADPTELALSGLEAFSFDYIVKWPLSLIINRKSLNRYQKSSGACAMEARGRRPGGWVDKTPRDRARPRGGGDTA

SEQ ID NO: 866875 - protein, 902 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 866876 - protein, 213 aa, Homo sapiens
MVRAGYSDEGERERVTEHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 866877 - protein, 95 aa, Homo sapiens
AVVSTHRVGHAPCWANVGQRNFSAHLLDLLARLSIYSTSDCEHGMASVISRGGWAPPRLSPSSAQSSACPCPAPPWLSPSSAQSSTCPCPTPPWP

SEQ ID NO: 866878 - protein, 701 aa, Homo sapiens; identical to SEQ ID NO: 866870

SEQ ID NO: 866879 - protein, 729 aa, Homo sapiens
MSKSETDPADEGTWLWGHGSGGCGATALSVPAGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 866880 - protein, 550 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRATSSCTSWTSRRRSSGSRWRTSRPLAWKRSWSWRCA

SEQ ID NO: 866881 - protein, 874 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRSRLDVNGIKSCWDSWI

SEQ ID NO: 866882 - protein, 405 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHSPGGRHAHPGEGAPDSGVTAGAAAQAGPPFAAEALVLHPASHAHHGHPGLPRHLGGQRRMSWGVHAEPAPRQELQLHRGQPGAGAMPVPNQGGQCSLLRGSGEVDLQGHHPRPIQ

SEQ ID NO: 866883 - protein, 696 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRCGSAARAPARSSLRFGRSENCATRWPPRPTEDPRRLSPAFSVREIHGLSGGHGADCGVQTPCPR

SEQ ID NO: 866884 - protein, 456 aa, Homo sapiens
MDKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 866885 - protein, 895 aa, Homo sapiens
EDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 866886 - protein, 871 aa, Homo sapiens
EDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLRYQ

SEQ ID NO: 866887 - protein, 859 aa, Homo sapiens
EDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKVSVRCMCMSSRNMTTGVSITHCCVPCNFPQRRPAQSEASPVASPDPQRQEWFARYFTF

SEQ ID NO: 866888 - protein, 839 aa, Homo sapiens
EDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKQKKKNDKSPTNSPAQSEASPVASPDPQRQEWFARYFTF

SEQ ID NO: 866889 - protein, 871 aa, Homo sapiens; identical to SEQ ID NO: 866886

SEQ ID NO: 866890 - protein, 310 aa, Homo sapiens
EDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEARIL

SEQ ID NO: 866891 - protein, 477 aa, Homo sapiens
PRLDPSPPCECMSVTQRRCEAEGPSGGAAAASTSSSGSSPSPAVRSNWSPALRERTTKQPQRLSLRPRLLSARLRGQLPLAGLGWRARRAAAERRAVCSRSPRTTLHPLASGLGGRSGIPATSNCPAISNKDQHSISYTLSRAQTVVVEYTHDSNTDMFQIGRSTESPIDFVVTDTVPGSQSNSDTQSVQSTISRFACRIICERNPPFTARIYAAGFDSSKNIFLGEKAAKWKTSDGQMDGLTTNGVLVMHPRNGFTEDSKPGIWREISVCGNVFSLRETRSAQQRGKMVEIETNQLQDGSLIDLCGATLLWRTAEGLSHTPTVKHLEALRQEINAARPQCPVGFNTLAFPSMKRKDVVDEKQPWVYLNCGHVHGYHNWGNKEERDGKDRECPMCRSVGPYVPLWLGCEAGFYVDAGPPTHAFSPCGHVCSEKTTAYWSQIPLPHGTHTFHAACPFCAHQLAGEQGYIRLIFQGPLD

SEQ ID NO: 866892 - protein, 418 aa, Homo sapiens
MFSPDQENHPSKAPVKYGELIVLGYNGSLPNGDRGRRKSRFALFKRPKANGVKPSTVHIACTPQAAKAISNKDQHSISYTLSRAQTVVVEYTHDSNTDMFQIGRSTESPIDFVVTDTVPGSQSNSDTQSVQSTISRFACRIICERNPPFTARIYAAGFDSSKNIFLGEKAAKWKTSDGQMDGLTTNGVLVMHPRNGFTEDSKPGIWREISVCGNVFSLRETRSAQQRGKMVEIETNQLQDGSLIDLCGATLLWRTAEGLSHTPTVKHLEALRQEINAARPQCPVGFNTLAFPSMKRKDVVDEKQPWVYLNCGHVHGYHNWGNKEERDGKDRECPMCRSVGPYVPLWLGCEAGFYVDAGPPTHAFSPCGHVCSEKTTAYWSQIPLPHGTHTFHAACPFCAHQLAGEQGYIRLIFQGPLD

SEQ ID NO: 866893 - protein, 136 aa, Homo sapiens
PRLDPSPPCECMSVTQRRCEAEGPSGGAAAASTSSSGSSPSPAVRSNWSPALRERTTKQPQRLSLRPRLLSARLRGQLPLAGLGWRARRAAAERRAVCSRSPRTTLHPLASGLGGRSGIPATSNCPEIMQKVSQGS

SEQ ID NO: 866894 - protein, 418 aa, Homo sapiens; identical to SEQ ID NO: 866892

SEQ ID NO: 866895 - protein, 320 aa, Homo sapiens
MFQIGRSTESPIDFVVTDTVPGSQSNSDTQSVQSTISRFACRIICERNPPFTARIYAAGFDSSKNIFLGEKAAKWKTSDGQMDGLTTNGVLVMHPRNGFTEDSKPGIWREISVCGNVFSLRETRSAQQRGKMVEIETNQLQDGSLIDLCGATLLWRTAEGLSHTPTVKHLEALRQEINAARPQCPVGFNTLAFPSMKRKDVVDEKQPWVYLNCGHVHGYHNWGNKEERDGKDRECPMCRSVGPYVPLWLGCEAGFYVDAGPPTHAFSPCGHVCSEKTTAYWSQIPLPHGTHTFHAACPFCAHQLAGEQGYIRLIFQGPLD

SEQ ID NO: 866896 - protein, 418 aa, Homo sapiens; identical to SEQ ID NO: 866892

SEQ ID NO: 866897 - protein, 136 aa, Homo sapiens; identical to SEQ ID NO: 866893

SEQ ID NO: 866898 - protein, 337 aa, Homo sapiens [sequence omitted]

SEQ ID NO: 866899 - protein, 337 aa, Homo sapiens [sequence omitted]

SEQ ID NO: 866900 - protein, 337 aa, Homo sapiens [sequence omitted]

SEQ ID NO: 866901 - protein, 337 aa, Homo sapiens [sequence omitted]

SEQ ID NO: 866902 - protein, 259 aa, Homo sapiens
MINYENFLKVGEKAGAKCKQFFTAKVFAKLLHTDSYGRISIMQFFNYVMRKVWLHQTRIGLSLYDVAGQGYLRESDLENYILELIPTLPQLDGLEKSFYSFYVCTAVRKFFFFLDPLRTGKIKIQDILACSFLDDLLELRDEELSKESQETNWFSAPSALRVYGQYLNLDKDHNGMLSKEELSRYGTATMTNVFLDRVFQECLTYDGEMDYKTYLDFVLALENRKEPAALQYIFKLLDIENKGYLNVFSLNYFFRIYFY

SEQ ID NO: 866903 - protein, 162 aa, Homo sapiens [sequence omitted]

SEQ ID NO: 866904 - protein, 162 aa, Homo sapiens [sequence omitted]

SEQ ID NO: 866905 - protein, 127 aa, Homo sapiens
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQNLWFLLDKHQTPPMIGRGSDDQLRKLFEGW

SEQ ID NO: 866906 - protein, 135 aa, Homo sapiens
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQVRTKQKVALDVNHFSFVLLKSCRISWCLMESVLQSGTT

SEQ ID NO: 866907 - protein, 337 aa, Homo sapiens [sequence omitted]

SEQ ID NO: 866908 - protein, 337 aa, Homo sapiens [sequence omitted]

SEQ ID NO: 866909 - protein, 323 aa, Homo sapiens
MKNYRQFFTAKVFAKLLHTDSYGRISIMQFFNYVMRKVWLHQTRIGLSLYDVAGQGYLRESDLENYILELIPTLPQLDGLEKSFYSFYVCTAVRKFFFFLDPLRTGKIKIQDILACSFLDDLLELRDEELSKESQETNWFSAPSALRVYGQYLNLDKDHNGMLSKEELSRYGTATMTNVFLDRVFQECLTYDGEMDYKTYLDFVLALENRKEPAALQYIFKLLDIENKGYLNVFSLNYFFRAIQELMKIHGQDPVSFQDVKDEIFDMVKPKDPLKISLQDLINSNQGDTVTTILIDLNGFWTYENREALVANDSENSADLDDT

SEQ ID NO: 866910 - protein, 321 aa, Homo sapiens
MINYENFLKVGEKAGAKCKQFFTAKVFAKLLHTDSYGRISIMQFFNYVMRKVWLHQTRIGLSLYDVAGQGYLRESDLENYILELIPTLPQLDGLEKSFYSFYVCTAVRKFFFFLDPLRTGKIKIQDILACSFLDDLLELRDEELSKESQETNWFSAPSALRVYGQYLNLDKDHNGMLSKEELSRYGTATMTNVFLDRVFQECLTYDGEMDYKTYLDFVLALENRKEPAALQYIFKLLDIENKGYLNVFSLNYFFRAIQELMKIHGQDPVSFQDVKDEIFDMVKPKDPLKISLQDLINSNQGDTVTTILIDLNGFWTYENRL

SEQ ID NO: 866911 - protein, 162 aa, Homo sapiens [sequence omitted]

SEQ ID NO: 866912 - protein, 127 aa, Homo sapiens; identical to SEQ ID NO: 866905

SEQ ID NO: 866913 - protein, 84 aa, Homo sapiens
MDWKEVLRRRLATPNTCPNKKKSEQELKDEEMDLFTKYYSEWKGGRKNTNEFYKTIPRFYYRGGMRHQSNTFEKYIGLIQKGGT

SEQ ID NO: 866914 - protein, 707 aa, Homo sapiens
SLLVLPLGTSAVSAFAPAGFSLRDCLGGHLECRRQDYTPGESTSATKPLKTRGRRATPFPSAPRGRGLDVAKETGSGPASTQGNRREPRDPEGCTQASAARTGPMRTEGLDFRRWDCHFAARVRPHRWSGLGTAGRVRFPGGSWCSRLAARKDQMAFEDVAVYFSQEEWGLLDTAQRALYRRVMLDNFALVASLGLSTSRPRVVIQLERGEEPWVPSGTDTTLSRTTYRRRNPGSWSLTEDRDVSGEWPRAFPDTPPGMTTSVFPVAGACHSVKSLQRQRGASPSRERKPTGVSVIYWERLLLGSGSGQASVSLRLTSPLRPPEGVRLREKTLTEHALLGRQPRTPERQKPCAQEVPGRTFGSAQDLEAAGGRGHHRMGAVWQEPHRLLGGQEPSTWDELGEALHAGEKSFECRACSKVFVKSSDLLKHLRTHTGERPYECAQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFKHQRVHTGEKPFACPQCGRAFSHSSNLTQHQLLHTGERPFRCVDCGKAFAKGAVLLSHRRIHTGEKPFVCTQCGRAFRERPALFHHQRIHTGEKTVRRSRASLHPQARSVAGASSEGAPAKETEPTPASGPAAVSQPAEV

SEQ ID NO: 866915 - protein, 109 aa, Homo sapiens
MCDTLLRTSPPQCNGPSWQGQKGGLGAICFLWPSADQALSLPGASPPRKFMFSLMEKKKKKRLPSATQSRCCSFLYSSLDLQSTASCPYSRAWFSLNSSSRASLIKVSF

SEQ ID NO: 866916 - protein, 553 aa, Homo sapiens
MAFEDVAVYFSQEEWGLLDTAQRALYRRVMLDNFALVASLGLSTSRPRVVIQLERGEEPWVPSGTDTTLSRTTYRRRNPGSWSLTEDRDVSGEWPRAFPDTPPGMTTSVFPVAGACHSVKSLQRQRGASPSRERKPTGVSVIYWERLLLGSGSGQASVSLRLTSPLRPPEGVRLREKTLTEHALLGRQPRTPERQKPCAQEVPGRTFGSAQDLEAAGGRGHHRMGAVWQEPHRLLGGQEPSTWDELGEALHAGEKSFECRACSKVFVKSSDLLKHLRTHTGERPYECAQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFKHQRVHTGEKPFACPQCGRAFSHSSNLTQHQLLHTGERPFRCVDCGKAFAKGAVLLSHRRIHTGEKPFVCTQCGRAFRERPALFHHQRIHTGEKTVRRSRASLHPQARSVAGASSEGAPAKETEPTPASGPAAVSQPAEV

SEQ ID NO: 866917 - protein, 285 aa, Homo sapiens
SLLVLPLGTSAVSAFAPAGFSLRDCLGGHLECRRQDYTPGESTSATKPLKTRGRRATPFPSAPRGRGLDVAKETGSGPASTQGNRREPRDPEGCTQASAARTGPMRTEGLDFRRWDCHFAARVRPHRWSGLGTAGRVRFPGGSWCSRLAARKDQMAFEDVAVYFSQEEWGLLDTAQRALYRRVMLDNFALVASLGLSTSRPRVVIQLERGEEPWVPSGTDTTLSRTTYRRRNPAHPAPAPAHGRAALPLRGLWQGLRQGRRAAQPPAHSHGREALRVYAVWPRLP

SEQ ID NO: 866918 - protein, 707 aa, Homo sapiens; identical to SEQ ID NO: 866914

SEQ ID NO: 866919 - protein, 669 aa, Homo sapiens
SLLVLPLGTSAVSAFAPAGFSLRDCLGGHLECRRQDYTPGESTSATKPLKTRGRRATPFPSAPRGRGLDVAKETGSGPASTQGNRREPRDPEGCTQASAARTGPMRTEGLDFRRWDCHFAARVRPHRWSGLGTAGRVRFPGGSWCSRLAARKDQMAFEDVAVYFSQEEWGLLDTAQRALYRRVMLDNFALVASLGLSTSRPRVVIQLERGEEPWVPSGTDTTLSRTTYRRRNPGSWSLTEDRDVSGEWPRAFPDTPPGMTTSVFPVAGACHSVKSLQRQRGASPSRERKPTGVSVIYWERLLLGSGSGQASVSLRLTSPLRPPEGVRLREKTLTEHALLGRQPRTPERQKPCAQEVPGRTFGSAQDLEAAGGRGHHRMGAVWQEPHRLLGGQEPSTWDELGEALHAGEKSFECRACSKVFVKSSDLLKHYAPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFKHQRVHTGEKPFACPQCGRAFSHSSNLTQHQLLHTGERPFRCVDCGKAFAKGAVLLSHRRIHTGEKPFVCTQCGRAFRERPALFHHQRIHTGEKTVRRSRASLHPQARSVAGASSEGAPAKETEPTPASGPAAVSQPAEV

SEQ ID NO: 866920 - protein, 707 aa, Homo sapiens; identical to SEQ ID NO: 866914

SEQ ID NO: 866921 - protein, 206 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFALLGLPGLRF

SEQ ID NO: 866922 - protein, 277 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 866923 - protein, 277 aa, Homo sapiens; identical to SEQ ID NO: 866922

SEQ ID NO: 866924 - protein, 277 aa, Homo sapiens; identical to SEQ ID NO: 866922

SEQ ID NO: 866925 - protein, 159 aa, Homo sapiens
MLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 866926 - protein, 159 aa, Homo sapiens; identical to SEQ ID NO: 866925

SEQ ID NO: 866927 - protein, 238 aa, Homo sapiens
YSKDPVLSGHVKRLKHCLINFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 866928 - protein, 196 aa, Homo sapiens
MFPFYSCWRTGLLLLLLAVAVRESWQTEEKTCDCNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 866929 - protein, 277 aa, Homo sapiens; identical to SEQ ID NO: 866922

SEQ ID NO: 866930 - protein, 312 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVAACGFDLFFNLLERERKQKWDIEGSAVLCAGCGMLLHLSLLLAQGSVFLPTFLWGKVFNPLMLPSSCLGHVPRNLD

SEQ ID NO: 866931 - protein, 277 aa, Homo sapiens; identical to SEQ ID NO: 866922

SEQ ID NO: 866932 - protein, 277 aa, Homo sapiens; identical to SEQ ID NO: 866922

SEQ ID NO: 866933 - protein, 288 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVAPMGGIWLPVNPNGWHWRGGPRGGHRGPLPRVLAPPPNRRLAPHHWAGTQRR

SEQ ID NO: 866934 - protein, 277 aa, Homo sapiens; identical to SEQ ID NO: 866922

SEQ ID NO: 866935 - protein, 239 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVASK

SEQ ID NO: 866936 - protein, 259 aa, Homo sapiens
MQSSPPAAVEREHRVVVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 866937 - protein, 117 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGRQF

SEQ ID NO: 866938 - protein, 277 aa, Homo sapiens; identical to SEQ ID NO: 866922

SEQ ID NO: 866939 - protein, 283 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVARKGTEAEVGHRGLCCPLRWVWNAAAPVPSAGSGKCLLAHISVGKGF

SEQ ID NO: 866940 - protein, 277 aa, Homo sapiens; identical to SEQ ID NO: 866922

SEQ ID NO: 866941 - protein, 195 aa, Homo sapiens [sequence omitted]

SEQ ID NO: 866942 - protein, 125 aa, Homo sapiens
PSPRPSHPGVSRPCASPDRHCERKTAGRDQSRCSFSRSLWAGAAPRGQERALESRSHHARSQRAVSFATPTRPFLFRRPLSPALPLCPCLALPSPSLPLSLFWPEPGPSHLLTGPLGLHRSPMAQ

SEQ ID NO: 866943 - protein, 155 aa, Homo sapiens
YQAPALPTPGSAGRVRPPTDTVNGRQQAAIRVAVHSAAASGPGRPPGARREPWSPAATMHAPSVLCPSPLPRARSSSVALCPLLYLSVLVWLSRHPPCLCLSSWPHRMAFREGGLGAWCRAGDRRESVTERGQGRGPEGVRDGGQREWMWGFEDV

SEQ ID NO: 866944 - protein, 117 aa, Homo sapiens
PSPRPSHPGVSRPCASPDRHCERKTAGRDQSRCSFSRSLWAGAAPRGQERALESRSHHARSQRAVSFATPTRPFLFRRPLSPALPLCPCLALPSPSLPLSLFWPEPGPSHLVTGGNR

SEQ ID NO: 866945 - protein, 125 aa, Homo sapiens; identical to SEQ ID NO: 866942

SEQ ID NO: 866946 - protein, 155 aa, Homo sapiens; identical to SEQ ID NO: 866943

SEQ ID NO: 866947 - protein, 125 aa, Homo sapiens; identical to SEQ ID NO: 866942

SEQ ID NO: 866948 - protein, 207 aa, Homo sapiens
MAVTITLKTLQQQTFKIRMEPDETVKVLKEKIEAEKGRDAFPVAGQKLIYAGKILSDDVPIRDYRIDEKNFVVVMVTKTKERPGITSDTPRRHSPHRLTPRDHYYSPFRAQAPPKTSRDNAHQDNTNPATDKEQGNQETHKRKGKHSTAHRHRSRHNRDRPQPGQQSTTPTPAPPGRGKEKEKPKTSTQQQPAPQRPAPAPRQHDNT

SEQ ID NO: 866949 - protein, 363 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 866950 - protein, 363 aa, Homo sapiens; identical to SEQ ID NO: 866949

SEQ ID NO: 866951 - protein, 220 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTQERTPWSSCGTSPSSRTCGR

SEQ ID NO: 866952 - protein, 253 aa, Homo sapiens [sequence omitted]

SEQ ID NO: 866953 - protein, 252 aa, Homo sapiens
QVAAGERKREQSLTQTLGTSWGRIPLMGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 866954 - protein, 363 aa, Homo sapiens; identical to SEQ ID NO: 866949

SEQ ID NO: 866955 - protein, 363 aa, Homo sapiens; identical to SEQ ID NO: 866949

SEQ ID NO: 866956 - protein, 107 aa, Homo sapiens
SDVEGEVGASSPGGSFSIWDVRQLPQGARSASGELADISDVEGEVGAIGEEAPQMNYIQVTPQEKEAIERLKALGFPESLVIQAYFACEKNENLAANFLLSQNFDDE

SEQ ID NO: 866957 - protein, 243 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVPALCSQTERRLLASPSSEKPLRTPPHPLLG

SEQ ID NO: 866958 - protein, 236 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRPADELHPGDAAGERSYREVEGPGLPREPGHPGLFRVCRTEPCL

SEQ ID NO: 866959 - protein, 303 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERVKALGFPESLGIQANTRGDTHGNWLQFPGVRIDDMMQEQA

SEQ ID NO: 866960 - protein, 363 aa, Homo sapiens; identical to SEQ ID NO: 866949

SEQ ID NO: 866961 - protein, 363 aa, Homo sapiens; identical to SEQ ID NO: 866949

SEQ ID NO: 866962 - protein, 452 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTVRWGFRLPGEALREYPGVTALMGGWEGKTCPEKPLGSDSSHYKASHRRLDVSDGWASGGQGRGLICVLPGHGGGWQQEVCALELKGPLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 866963 - protein, 359 aa, Homo sapiens
DPHASGYSSIAIAVVYPKKPVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 866964 - protein, 363 aa, Homo sapiens; identical to SEQ ID NO: 866949

SEQ ID NO: 866965 - protein, 229 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRPADELHPGDAAGERSYREVEGPGLPREPGHPGLFRV

SEQ ID NO: 866966 - protein, 171 aa, Homo sapiens
AHHDVRIVGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 866967 - protein, 345 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACG

SEQ ID NO: 866968 - protein, 243 aa, Homo sapiens; identical to SEQ ID NO: 866957

SEQ ID NO: 866969 - protein, 243 aa, Homo sapiens; identical to SEQ ID NO: 866957

SEQ ID NO: 866970 - protein, 528 aa, Homo sapiens
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKRFHLQPRMIGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 866971 - protein, 562 aa, Homo sapiens
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRVKDEFSDLSEGDVLSEDENDKKQNAQSSDESFEPYPERKVSGKKSESKEAKKSEEPRIRKKPGPKPGWKKKLRCERCCLQREARPACRGRGSMHALHCREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 866972 - protein, 352 aa, Homo sapiens
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRVKDEFSDLSEGDVLSEDENDKKQNAQSSDESFEPYPERKVSGKKSESKEAKKSEEPRIRKKPGPKPGWKKKLRCER

SEQ ID NO: 866973 - protein, 138 aa, Homo sapiens [sequence omitted]

SEQ ID NO: 866974 - protein, 154 aa, Homo sapiens
VFPAVMVSHCHRRPPGGWSIRGLDSLDSPLSEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 866975 - protein, 626 aa, Homo sapiens
NAGSSRNLGPGSTRGILLASSAAMKRDRLGRFLSPGSSRQCGASDGGGGVSRTRGRPSLSGGPRVDGATARRAWGPVGSCGDAGEDGADEAGAGRALAMGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKRFHLQPRMIGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 866976 - protein, 539 aa, Homo sapiens
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRVKDEFSDLSEGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 866977 - protein, 522 aa, Homo sapiens
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLAPSACTAWWGGCMDMRPAAGPCPTFRGHCPPSTAASSRSCGAATRATTTPWIPAPAARPSCWTVRWQSSGHGTKRRRHGCPSTEGGTLGMPLRPPRVEGQGPQLGLRPRPCPARMWPSLLRTATRWGPGRASHLSQACPFAGPQGSWVRSSFHLQPRMIGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 866978 - protein, 551 aa, Homo sapiens
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKRFHLQPRMIGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQKCESGPPPRAVALAPSYLPLSPRCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 866979 - protein, 134 aa, Homo sapiens
LGSPQEHRSPETSQEEAAVSVFQILPSPQAAMVSSQLARGHTSQNAEKAGWLGMALVEFSPYLVWKQGAKSYLFPPASLLPPTGFLTSQDQLEKVVRVGKRLLSEDCPANQLGFIPFTSTFCTRGRGKGGSPGS

SEQ ID NO: 866980 - protein, 134 aa, Homo sapiens; identical to SEQ ID NO: 866979

SEQ ID NO: 866981 - protein, 134 aa, Homo sapiens; identical to SEQ ID NO: 866979

SEQ ID NO: 866982 - protein, 134 aa, Homo sapiens; identical to SEQ ID NO: 866979

SEQ ID NO: 866983 - protein, 378 aa, Homo sapiens
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSAESTSADTVLLTSKESKVWDLPSTSHVSMWKTSDSVSSPQPGASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 866984 - protein, 378 aa, Homo sapiens; identical to SEQ ID NO: 866983

SEQ ID NO: 866985 - protein, 779 aa, Homo sapiens
SPGVRVRGAGSGSPRAAAPPSRSVGGCGVSRGPGVSAGRGPRFAGPCERAQARVASGRASRWVNPASHAWGGPLAHLQTIVSCARSFVGATSPWSSCGCGSSGAIPRRLRESLDSRWSLSRVGPSNTATAGKPSPYGSCPSETPVLGSLACLASGHRPTKLAPKSRMHPEGRHSVTFVPSGAARGLSRMVPSSPAVEKQVPVEPGPDPELRSWRRLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 866986 - protein, 528 aa, Homo sapiens
SPGVRVRGAGSGSPRAAAPPSRRHSVTFVPSGAARGLSRMVPSSPAVEKQVPVEPGPDPELRSWRRLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQNEELHVASLSLWKSHLRLAADTLSSEGSSGSGPRSWFLSPTLRAALHGPVCPSEVCPS

SEQ ID NO: 866987 - protein, 630 aa, Homo sapiens
SPGVRVRGAGSGSPRAAAPPSRRHSVTFVPSGAARGLSRMVPSSPAVEKQVPVEPGPDPELRSWRRLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 866988 - protein, 630 aa, Homo sapiens; identical to SEQ ID NO: 866987

SEQ ID NO: 866989 - protein, 551 aa, Homo sapiens
MSRSPRARGRVREPQGSRPAESQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 866990 - protein, 146 aa, Homo sapiens
SPGVRVRGAGSGSPRAAAPPSRRHSVTFVPSGAARGLSRMVPSSPAVEKQVPVEPGPDPELRSWRRLVCYLCFYGFMAQIRPGESFITPYLLGPDKNFTREQARTGSCPGSGCRWRGWGWSGGAISLTPHEMPSAPGQSVPLPATH

SEQ ID NO: 866991 - protein, 630 aa, Homo sapiens; identical to SEQ ID NO: 866987

SEQ ID NO: 866992 - protein, 630 aa, Homo sapiens; identical to SEQ ID NO: 866987

SEQ ID NO: 866993 - protein, 630 aa, Homo sapiens; identical to SEQ ID NO: 866987

SEQ ID NO: 866994 - protein, 584 aa, Homo sapiens
AVEEVQGEEREGSGWLPRGSSALRPSTKTRRCLMRPQPAEPAPGGRGNEACSIHSEVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 866995 - protein, 207 aa, Homo sapiens
MCQTLRHPGGQPFPLVGPPVPHRSLRLASFPSLRAQPAPGQLPVPAATPLLGHRLMPENSQESHAMFNERQNVGTRCEAVPGCGRETPGCARQGAFLLDLEGHPMSWGREGRGAYPCDRTLPVATGRAQQNPQFVSGHVPTSDSAASPTCTLSQEAAVSRPAPQPEGFLLVTQNCLPQVPGQEMSLNFPAPSPVDILGVRHTSAHSH

SEQ ID NO: 866996 - protein, 201 aa, Homo sapiens
LSPTQPKIQHPDDKTQVKEEMMDNRGNSSLPDKLPIFPDSARLPLTRSFYLEPMVTFHVHPEAPVSSPYSEELPRLPFPSDSLILGNYSEPCPFSFPMPYPNYRGCEYSYGPAFTRKRNERERQRVKCVNEGYAQLRHHLPEEYLEKRLSKVETLRAAIKYINYLQSLLYPDKAETKNNPGKVSSMIATTSHHADPMFRIV

SEQ ID NO: 866997 - protein, 202 aa, Homo sapiens
VSAIISYLPVYLILIISVKEEMMDNRGNSSLPDKLPIFPDSARLPLTRSFYLEPMVTFHVHPEAPVSSPYSEELPRLPFPSDSLILGNYSEPCPFSFPMPYPNYRGCEYSYGPAFTRKRNERERQRVKCVNEGYAQLRHHLPEEYLEKRLSKVETLRAAIKYINYLQSLLYPDKAETKNNPGKVSSMIATTSHHADPMFRIV

SEQ ID NO: 866998 - protein, 842 aa, Homo sapiens
MDISKGLPGMQGGLHIWISENRKMVPVPEGAYGNFFEEHCYVILHVPQSPKATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLALTYSLRDRERGGGRAQIGVVDDEAKAPDLMQIMEAVLGRRVGSLRAATPSKDINQLQKANVRLYHVYEKGKDLVVLETFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 866999 - protein, 320 aa, Homo sapiens
SFLHEQRGTLYPEQSGVLGEKPRGSEEGPGLPLLRSGFPGPGVGHLCHGLGCPSGWLTALLSVLARLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 867000 - protein, 833 aa, Homo sapiens
SSPSPPAPPSSPQHIYTNTRTLGPPEPEATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLALTYSLRDRERGGGRAQIGVVDDEAKAPDLMQIMEAVLGRRVGSLRAATPSKDINQLQKANVRLYHVYEKGKDLVVLELATPPLTQDLLQEEDFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 867001 - protein, 856 aa, Homo sapiens
MDISKGLPGMQGGLHIWISENRKMVPVPEGAYGNFFEEHCYVILHVPQSPKATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLALTYSLRDRERGGGRAQIGVVDDEAKAPDLMQIMEAVLGRRVGSLRAATPSKDINQLQKANVRLYHVYEKGKDLVVLELATPPLTQDLLQEEDFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 867002 - protein, 531 aa, Homo sapiens
AAGPGILEGWLRSGRGGDGVGGGQRAPLTPTVPPSDKSIHVKLDVGKLHTQPKLAAQLRMVDDGSGKVEVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 867003 - protein, 444 aa, Homo sapiens
SSPSPPAPPSSPQHIYTNTRTLGPPEPEATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLALTYSLRDRERGGGRAQIGVVDDEAKAPDLMQIMEAVLGRRVGSLRAATPSKDINQLQKANVRLYHVYEKGKDLVVLELATPPLTQDLLQEEDFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEVWCIQDLHRQPVDPKRHGQLCAGNCYLVLYTYQRLGRVQYILYLWQGHQATADEIEVLQGLSPEEHRYRVCSE

SEQ ID NO: 867004 - protein, 856 aa, Homo sapiens; identical to SEQ ID NO: 867001

SEQ ID NO: 867005 - protein, 859 aa, Homo sapiens
SSPSPPAPPSSPQHIYTNTRTLGPPEPEATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLALTYSLRDRERGGGRAQIGVVDDEAKAPDLMQIMEAVLGRRVGSLRAATPSKDINQLQKANVRLYHVYEKGKDLVVLELATPPLTQDLLQEEDFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEGLPGILPESAWLQVCTPQEEETTLTDVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 867006 - protein, 672 aa, Homo sapiens
SSPSPPAPPSSPQHIYTNTRTLGPPEPEATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLALTYSLRDRERGGGRAQIGVVDDEAKAPDLMQIMEAVLGRRVGSLRAATPSKDINQLQKANVRLYHVYEKGKDLVVLELATPPLTQDLLQEEDFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEGLPGILPESAWLQVCTPQEEETTLTDVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEVRWLSLPGGAVNGGVFLFV

SEQ ID NO: 867007 - protein, 79 aa, Homo sapiens
MVSLNGIEWNHHQMEMNGIVIEWNRMDSLNGIDGIIEWNGMEQSMNSNGIIIEWNRMESSSGIEWNYDQMESNVIIIKW

SEQ ID NO: 867008 - protein, 614 aa, Homo sapiens
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSATSFVAGFVVFSILGFMSQEQGVPISEVAESGPGLAFIAFPKAVTMMPLSQLWSCLFFIMLIFLGLDSQFVCVECLVTASIDMFPRQLRKSGRRELLILTIAVMCYLIGLFLVTEGGMYIFQLFDYYASSGICLLFLSLFEVVCISWVYGADRFYDNIEDMIGYRPWPLVKISWLFLTPGLCLATFLFSLSKYTPLKYNNVYVYPPWGYSIGWFLALSSMVCVPLFVVITLLKTRGPFRKRLRQLITPDSSLPQPKQHPCLDGSAGRNFGPSPTREGLIAGEKETHL

SEQ ID NO: 867009 - protein, 614 aa, Homo sapiens; identical to SEQ ID NO: 867008

SEQ ID NO: 867010 - protein, 60 aa, Homo sapiens
MLGRHSLWEGTIVFIKGGLFGGRHLIATPRVMRIPLWGCLLLERTAFVHGERSYNWNAHC

SEQ ID NO: 867011 - protein, 614 aa, Homo sapiens; identical to SEQ ID NO: 867008

SEQ ID NO: 867012 - protein, 366 aa, Homo sapiens [sequence omitted]

SEQ ID NO: 867013 - protein, 74 aa, Homo sapiens
MLPAGEIGASPAAPSCSVGTKGQGRESADKGELTPYGPAFIDKNCVTLDRCETLEPHRADDRIMMQYQPCTHES

SEQ ID NO: 867014 - protein, 792 aa, Homo sapiens
MLPAGEIGASPAAPCCSESGDERKNLEEKSDINVTVLIGSKQVSEGTDNGDLPSYVSAFIEKEVGNDLKSLKKLDKLIEQRTVSKMQLEEQVLTISSEIPKRIRSALKNAEESKQFLNQFLEQETHLFSAINSHLLTAQPWMDDLGTMISQIEEIERHLAYLKWISQIEELSDNIQQYLMTNNVPEAASTLVSMAELDIKLQESSCTHLLGFMRATVKFWHKILKDKLTSDFEEILAQLHWPFIAPPQSQTVGLSRPASAPEIYSYLETLFCQLLKLQTSDELLTEPKQLPEKYSLPASPSVILPIQVMLTPLQKRFRYHFRGNRQTNVLSKPEWYLAQVLMWIGNHTEFLDEKIQPILDKVGSLVNARLEFSRGLMMLVLEKLATDIPCLLYDDNLFCHLVDEVLLFERELHSVHGYPGTFASCMHILSEETCFQRWLTVERKFALQKMDSMLSSEAAWVSQYKDITDVDEMKVPDCAETFMTLLLVITDRYKNLPTASRKLQFLELQKDLVDDFRIRLTQVMKEETRASLGFRYCAILNAVNYISTVLADWADNVFFLQLQQAALEVFAENNTLSKLQLGQLASMESSVFDDMINLLERLKHDMLTRQVDHVFREVKDAAKLYKKERWLSLPSQSEQAVMSLSSSACPLLLTLRDHLLQLEQQLCFSLFKIFWQMLVEKLDVYIYQEIILANHFNEGGAAQLQFDMTRNLFPLFSHYCKRPENYFKHIKEACIVLNLNVGSALLLKDVLQSASGQLPATAALNEVGIYKLAQQDVEILLNLRTNWPNTGK

SEQ ID NO: 867015 - protein, 764 aa, Homo sapiens
MLPAGEIGASPAAPCCSESGDERKNLEEKSDINVTVLIGSKQVSEGTDNGDLPSYVSAFIEKEVGNDLKSLKKLDKLIEQRTVSKMQLEEQFLEQETHLFSAINSHLLTAQPWMDDLGTMISQIEEIERHLAYLKWISQIEELSDNIQQYLMTNNVPEAASTLVSMAELDIKLQESSCTHLLGFMRATVKFWHKILKDKLTSDFEEILAQLHWPFIAPPQSQTVGLSRPASAPEIYSYLETLFCQLLKLQTSDELLTEPKQLPEKYSLPASPSVILPIQVMLTPLQKRFRYHFRGNRQTNVLSKPEWYLAQVLMWIGNHTEFLDEKIQPILDKVGSLVNARLEFSRGLMMLVLEKLATDIPCLLYDDNLFCHLVDEVLLFERELHSVHGYPGTFASCMHILSEETCFQRWLTVERKFALQKMDSMLSSEAAWVSQYKDITDVDEMKVPDCAETFMTLLLVITDRYKNLPTASRKLQFLELQKDLVDDFRIRLTQVMKEETRASLGFRYCAILNAVNYISTVLADWADNVFFLQLQQAALEVFAENNTLSKLQLGQLASMESSVFDDMINLLERLKHDMLTRQVDHVFREVKDAAKLYKKERWLSLPSQSEQAVMSLSSSACPLLLTLRDHLLQLEQQLCFSLFKIFWQMLVEKLDVYIYQEIILANHFNEGGAAQLQFDMTRNLFPLFSHYCKRPENYFKHIKEACIVLNLNVGSALLLKDVLQSASGQLPATAALNEVGIYKLAQQDVEILLNLRTNWPNTGK

SEQ ID NO: 867016 - protein, 792 aa, Homo sapiens; identical to SEQ ID NO: 867014

SEQ ID NO: 867017 - protein, 774 aa, Homo sapiens
MLPAGEIGASPAAPCCSESGDERKNLEEKSDINVTVLIGSKQVSEGTDNGDLPSYVSAFIEKEVGNDLKSLKKLDKLIEQRTVSKMQLEEQVLTISSEIPKRIRSALNLFSAINSHLLTAQPWMDDLGTMISQIEEIERHLAYLKWISQIEELSDNIQQYLMTNNVPEAASTLVSMAELDIKLQESSCTHLLGFMRATVKFWHKILKDKLTSDFEEILAQLHWPFIAPPQSQTVGLSRPASAPEIYSYLETLFCQLLKLQTSDELLTEPKQLPEKYSLPASPSVILPIQVMLTPLQKRFRYHFRGNRQTNVLSKPEWYLAQVLMWIGNHTEFLDEKIQPILDKVGSLVNARLEFSRGLMMLVLEKLATDIPCLLYDDNLFCHLVDEVLLFERELHSVHGYPGTFASCMHILSEETCFQRWLTVERKFALQKMDSMLSSEAAWVSQYKDITDVDEMKVPDCAETFMTLLLVITDRYKNLPTASRKLQFLELQKDLVDDFRIRLTQVMKEETRASLGFRYCAILNAVNYISTVLADWADNVFFLQLQQAALEVFAENNTLSKLQLGQLASMESSVFDDMINLLERLKHDMLTRQVDHVFREVKDAAKLYKKERWLSLPSQSEQAVMSLSSSACPLLLTLRDHLLQLEQQLCFSLFKIFWQMLVEKLDVYIYQEIILANHFNEGGAAQLQFDMTRNLFPLFSHYCKRPENYFKHIKEACIVLNLNVGSALLLKDVLQSASGQLPATAALNEVGIYKLAQQDVEILLNLRTNWPNTGK

SEQ ID NO: 867018 - protein, 138 aa, Homo sapiens
VPLYLVSRLYLVSRLYLVSRLYLVSRLYLVARLYLVSRLYLVSRLYLVSRLYLVSRLYLVSRLYLVSRLYLVPRLYLVSALPCLGSTLSRLYLVSRLYLVLVKSRSCDFLFHEADKYEAVEKILKNEIKLSNFIIFTD

SEQ ID NO: 867019 - protein, 251 aa, Homo sapiens
MNWEWGPADQFSVTFSPFHVNRIARDRLPWICFSKNSVSAQSIDRTGGCVCVSCWVFLISYIIQNHTISHQRVADTMLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 867020 - protein, 175 aa, Homo sapiens
MLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 867021 - protein, 547 aa, Homo sapiens
MFYYPNVLQRHTGCFATIWLAATRGSRLVKREYLRVNVVKTCEEILNYVLVRVQPPQPGLPRPRFSLYLSAQLQIGVIRVYSQQCQYLVEDIQHILERLHRAQLQIRIDMETELPSLLLPNHLAMMETLEDAPDPFFGMMSVDPRLPSPFDIPQIRHLLEAAIPERVEEIPPEVPTEPREPERIPVTVLPPEAITILEAEPIRMLEIEGERELPEVSRRELDLLIAEEEEAILLEIPRLPPPAPAEVEGIGEALGPEELRLTGWEPGALLMEVTPPEELRLPAPPSPERRPPVPPPPRRRRRRRLLFWDKETQISPEKFQEQLQTRAHCWECPMVQPPERTIRGPAELFRTPTLSGWLPPELLGLWTHCAQPPPKALRRELPEEAAAEEERRKIEVPSEIEVPREALEPSVPLMVSLEISLEAAEEEKSRISLIPPEERWAWPEVEAPEAPALPVVPELPEVPMEMPLVLPPELELLSLEAVHRAVALELQANREPDFSSLVSPLSPRRMAARVFYLLLVLSAQQILHVKQEKPYGRLLIQPGPRFH

SEQ ID NO: 867022 - protein, 547 aa, Homo sapiens; identical to SEQ ID NO: 867021

SEQ ID NO: 867023 - protein, 603 aa, Homo sapiens
MFYYPNVLQRHTGCFATIWLAATRGSRLVKREYLRVNVVKTCEEILNYVLVRVQPPQPGLPRPRFSLYLSAQLQIGVIRVYSQQCQYLVEDIQHILERLHRAQLQIRIDMETELPSLLLPNHLAMMETLEDAPDPFFGMMSVDPRLPSPFDIPQIRHLLEAAIPERVEEIPPEVPTEPREPERIPVTVLPPEAITILEAEPIRMLEIEGERELPEVSRRELDLLIAEEEEAILLEIPRLPPPAPAEVEGIGEALGPEELRLTGWEPGALLMEVTPPEELRLPAPPSPERRPPVPPPPRRRRRRRLLFWDKETQISPEKFQEQLQTRAHCWECPMVQPPERTIRGPAELFRTPTLSGWLPPELLGLWTHCAQPPPKALRRELPEEAAAEEERRKIEVPSEIEVTAPPVYCIAPVPGLPDQLAALSCYESQQHRLTGLVPSEAQVPDAWGLSSTSPIPRVPREALEPSVPLMVSLEISLEAAEEEKSRISLIPPEERWAWPEVEAPEAPALPVVPELPEVPMEMPLVLPPELELLSLEAVHRAVALELQANREPDFSSLVSPLSPRRMAARVFYLLLVLSAQQILHVKQEKPYGRLLIQPGPRFH

SEQ ID NO: 867024 - protein, 547 aa, Homo sapiens; identical to SEQ ID NO: 867021

SEQ ID NO: 867025 - protein, 688 aa, Homo sapiens
MFYYPNVLQRHTGCFATIWLAATRGSRLVKREYLRVNVVKTCEEILNYVLVRVQPPQPGLPRPRFSLYLSAQLQIGVIRVYSQQCQYLVEDIQHILERLHRAQLQIRIDMETELPSLLLPNHLAMMETLEDAPDPFFGMMSVDPRLPSPFDIPQIRHLLEAAIPERVEEIPPEVPTEPREPERIPVTVLPPEAITILEAEPIRMLEIEGERELPEVSRRELDLLIAEEEEAILLEIPRLPPPAPAEVEGIGEALGPEELRLTGWEPGALLMEVTPPEELRLPAPPSPERRPPVPPPPRRRRRRRLLFWDKETQISPEKFQEQLQTRAHCWECPMVQPPERTIRGPAELFRTPTLSGWLPPELLGLWTHCAQPPPKALRRELPEEAAAEEERRKIEVPSEIEVPREALEPSVPLMVSLEISLEAAEEEKSRISLIPPEERWAWPEVEAPEAPALPVVPELPEVPMEMPLVLPPELELLSLEAVHRAVALELQANREPDFSSLVSPLSPRRMAARVFYLLLGECMHVCVCMWGRDTETRGPYRDSPDLPSPRLLTSALSATDSSRETRKAIWSPPDPAGAQIPLRLESIYKAARKPATSSKPRRASLGPAYLISECAFPAFLLSELLFKQKTSCFYYSKKKKKKPRGTHTIRGGGNKRVMNWAPGHITGFPDPRFVDQGGTLRGPPKGSE

SEQ ID NO: 867026 - protein, 468 aa, Homo sapiens
WLSTSSSLPTEDIQHILERLHRAQLQIRIDMETELPSLLLPNHLAMMETLEDAPDPFFGMMSVDPRLPSPFDIPQIRHLLEAAIPERVEEIPPEVPTEPREPERIPVTVLPPEAITILEAEPIRMLEIEGERELPEVSRRELDLLIAEEEEAILLEIPRLPPPAPAEVEGIGEALGPEELRLTGWEPGALLMEVTPPEELRLPAPPSPERRPPVPPPPRRRRRRRLLFWDKETQISPEKFQEQLQTRAHCWECPMVQPPERTIRGPAELFRTPTLSGWLPPELLGLWTHCAQPPPKALRRELPEEAAAEEERRKIEVPSEIEVPREALEPSVPLMVSLEISLEAAEEEKSRISLIPPEERWAWPEVEAPEAPALPVVPELPEVPMEMPLVLPPELELLSLEAVHRAVALELQANREPDFSSLVSPLSPRRMAARVFYLLLVLSAQQILHVKQEKPYGRLLIQPGPRFH

SEQ ID NO: 867027 - protein, 134 aa, Homo sapiens [sequence omitted]

SEQ ID NO: 867028 - protein, 94 aa, Homo sapiens
QGLFWEYLDTAADKGFISQLAKGRTLQFLALASARGKGLMGQSPLGVVAEVTPPEELRLPAPPSPEVSSLPSNPPPPPLCPPPQGLPPQAQGHC

SEQ ID NO: 867029 - protein, 202 aa, Homo sapiens
MVQPPERTIRGPAELFRTPTLSGWLPPELLGLWTHCAQPPPKALRRELPEEAAAEEERRKIEVPSEIEVPREALEPSVPLMVSLEISLEAAEEEKSRISLIPPEERWAWPDGRRTRQEAPCNSAQVDAIESPIEGCPWDDSPLWRACPPRDSEVDLNLEAAAPWARCHWSFEAKRRSPILRRTGVTLSAPASMRRPGLQPRR

SEQ ID NO: 867030 - protein, 658 aa, Homo sapiens
MFYYPNVLQRHTGCFATIWLAATRGSRLVKREYLRVNVVKTCEEILNYVLVRVQPPQPGLPRPRFSLYLSAQLQIGVIRVYSQQCQYLVEDIQHILERLHRAQLQIRIDMETELPSLLLPNHLAMMETLEDAPDPFFGMMSVDPRLPSPFDIPQIRHLLEAAIPERVEEIPPEVPTEPREPERIPVTVLPPEAITILEAEPIRMLEIEGERELPEVSRRELDLLIAEEEEAILLEIPRLPPPAPAEVEGIGEALGPEELRLTGWEPGALLMEVTPPEELRLPAPPSPEVSSLPSNPPPPPLCPPPQGLPPQAQGHCQLTGVLNADDKRCPFLRPIVSGLRFPDGYPYARYELLKCMETPHKPSPGSSRGGCGVLLAVHQNDRKRSNGQPCPYLALPTQQRRPPVPPPPRRRRRRRLLFWDKETQISPEKFQEQLQTRAHCWECPMVQPPERTIRGPAELFRTPTLSGWLPPELLGLWTHCAQPPPKALRRELPEEAAAEEERRKIEVPSEIEVPREALEPSVPLMVSLEISLEAAEEEKSRISLIPPEERWAWPEVEAPEAPALPVVPELPEVPMEMPLVLPPELELLSLEAVHRAVALELQANREPDFSSLVSPLSPRRMAARVFYLLLVLSAQQILHVKQEKPYGRLLIQPGPRFH

SEQ ID NO: 867031 - protein, 685 aa, Homo sapiens
MFYYPNVLQRHTGCFATIWLAATRGSRLVKREYLRVNVVKTCEEILNYVLVRVQPPQPGLPRPRFSLYLSAQLQIGVIRVYSQQCQYLVEDIQHILERLHRAQLQIRIDMETELPSLLLPNHLAMMETLEDAPDPFFGMMSVDPRLPSPFDIPQIRHLLEAAIPERVEEIPPEVPTEPREPERIPVTVLPPEAITILEAEPIRMLEIEGERELPEVSRRELDLLIAEEEEAILLEIPRLPPPAPAEYGQELLDQVGCQCWEGSPHFSCPFPLRVEGIGEALGPEELRLTGWEPGALLMEVTPPEELRLPAPPSPEVSSLPSNPPPPPLCPPPQGLPPQAQGHCQLTGVLNADDKRCPFLRPIVSGLRFPDGYPYARYELLKCMETPHKPSPGSSRGGCGVLLAVHQNDRKRSNGQPCPYLALPTQQRRPPVPPPPRRRRRRRLLFWDKETQISPEKFQEQLQTRAHCWECPMVQPPERTIRGPAELFRTPTLSGWLPPELLGLWTHCAQPPPKALRRELPEEAAAEEERRKIEVPSEIEVPREALEPSVPLMVSLEISLEAAEEEKSRISLIPPEERWAWPEVEAPEAPALPVVPELPEVPMEMPLVLPPELELLSLEAVHRAVALELQANREPDFSSLVSPLSPRRMAARVFYLLLVLSAQQILHVKQEKPYGRLLIQPGPRFH

SEQ ID NO: 867032 - protein, 547 aa, Homo sapiens; identical to SEQ ID NO: 867021

SEQ ID NO: 867033 - protein, 247 aa, Homo sapiens
MFYYPNVLQRHTGCFATIWLAATRGSRLVKREYLRVNVVKTCEEILNYVLVRVQPPQPGLPRPRFSLYLSAQLQIGVIRVYSQQCQYLVEDIQHILERLHRAQLQIRIDMETELPSLLLPNHLAMMETLEDAPDPFFGMMSVDPRLPSPFDIPQIRHLLEAAIPERVEEIPPEVPTEPREPERIPVTVLPPEAITILEAEPIRMLEIEGERELPEVSRRELDLLIAEEEEAILLETSRGSTAGYSEV

SEQ ID NO: 867034 - protein, 152 aa, Homo sapiens
MGMPLVTVTAATFPTLSCPPRAWPEVEAPEAPALPVVPELPEVPMEMPLVLPPELELLSLEAVHRYQGGGTLMGWTRAEASANVLDPYRAVALELQANREPDFSSLVSPLSPRRMAARVFYLLLVLSAQQILHVKQEKPYGRLLIQPGPRFH

SEQ ID NO: 867035 - protein, 1090 aa, Homo sapiens
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAAAQRSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 867036 - protein, 943 aa, Homo sapiens
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRVGRVLGQWPCPALAAVCWVAGLAAPSVRPCLLTEASLQRATSASRSQPSYTVHLHLLQQLVSHEVTQHELLGLGAAGAALQVLTSSTCSPQAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSRSVAAPALGALATSPSPPTAPPSWAPASVLRGVAAPALGALATSPSPPTAPLSWASASVLRGGGESLW

SEQ ID NO: 867037 - protein, 943 aa, Homo sapiens; identical to SEQ ID NO: 867036

SEQ ID NO: 867038 - protein, 1276 aa, Homo sapiens
MATLLSHPQQRPPFLRQAIKIRRRRVRDLQDPPPQMAPEVGVTSLGRELALGSTVVSGTGALLSGPTSRRLGLGTSDPPLPTPPWGEPPGPAEQGLPDGLWATVGLRPCGLRLSEPLPPGWPDPIPYSSSFRRADSIRWGCPCCGVSCSGSSRPPGRRGTPLTSAAEPHFRCWVRSKPPLISRAVPSGEGREVGCGCGGLALLGTHGPQPRRAQDGPPGGLLGEQIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAAPSSSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 867039 - protein, 944 aa, Homo sapiens
MRLGGGKFGRDRLQLHGSGLWSLTASSGGIHPPGPSTTPFSPYREFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAAPSSSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 867040 - protein, 886 aa, Homo sapiens
HGLGIPACQDLRCREDQWYPLEPRTETYPDRGQCHLQFQLIHKRVGRVLGQWPCPALAAVCWVAGLAAPSVRPCLLTEASLQRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAAPSSSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 867041 - protein, 694 aa, Homo sapiens
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRVGRVLGQLAMPSSCGGLLGCGAGCTQCEALSAHRGLIAESHFGQPLAAELHRAPPPPAAACVPRGHPARVGHEIRTGVRTLAEQLEVGIAKHIQKLVGVRESVLPEDAILPLMKFLEVELCYMNTNLVQENFSSLLTLLWTHTLTVLVEAAAPSSSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 867042 - protein, 326 aa, Homo sapiens
PGRFQGCRGGQCGWDRLSNGEGKAEGHSAPDEVPGGGALLHEHQLGAGELQQPPDPALDPHTHSAGGGGRSQRSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 867043 - protein, 281 aa, Homo sapiens
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQVRRMRKGAQERGRGRGLGGVLGRGSVSSQS

SEQ ID NO: 867044 - protein, 111 aa, Homo sapiens [sequence omitted]

SEQ ID NO: 867045 - protein, 943 aa, Homo sapiens; identical to SEQ ID NO: 867036

SEQ ID NO: 867046 - protein, 1055 aa, Homo sapiens
MAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAAPSSSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 867047 - protein, 1286 aa, Homo sapiens
MATLLSHPQQRPPFLRQAIKIRRRRVRDLQDPPPQMAPEVGVTSLGRELALGSTVVSGTGALLSGPTSRRLGLGTSDPPLPTPPWGEPPGPAEQGLPDGLWATVGLRPCGLRLSEPLPPGWPDPIPYSSSFRRADSIRWGCPCCGVSCSGSSRPPGRRGTPLTSAAEPHFRCWVRSKPPLISRAVPSGEGREVGCGCGGLALLGTHGPQPRRAQDGPPGGLLGEQIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILALNHALFSNREFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAAPSSSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 867048 - protein, 769 aa, Homo sapiens
MSVGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAAPSSSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 867049 - protein, 985 aa, Homo sapiens
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAAAQRSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEL

SEQ ID NO: 867050 - protein, 231 aa, Homo sapiens [sequence omitted]

SEQ ID NO: 867051 - protein, 186 aa, Homo sapiens
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQGWHRQTEAERTVWLLCLLRTPPPRTAPAT

SEQ ID NO: 867052 - protein, 122 aa, Homo sapiens
MATLLSHPQQRPPFLRQAIKIRRRRVRDLQDPPPQMAPEVGVTSLGRELALGSTVVSGTGALLSGPTSRRLGLGTSDPPLPTPPWGEPPGPAEQGLPDGLWATVGLRPCGLRLSEPLPSRLA

SEQ ID NO: 867053 - protein, 122 aa, Homo sapiens
MVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTVSFIQKL

SEQ ID NO: 867054 - protein, 477 aa, Homo sapiens
MEIYFFHLFLLYTFNILISLGPYFPCRENIKLIGGKSNIRPPRPELNMCLLPTMVETSKGKDDVYDRMLLDYFFSYHQFIHLLCRVAINCEKFTETLVKLSVLVAYEGLPLHLALFPKLWTELCQTQSAMSKNCIKLLCEDPVFAEYIKCILMDERTFLNNNIVYTFMTHFLLKVQSQVFSEANCANLISTLITNLISQYQNLQSDFSNRVEISKASASLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 867055 - protein, 348 aa, Homo sapiens [sequence omitted]

SEQ ID NO: 867056 - protein, 567 aa, Homo sapiens
MDKQPLNTGGQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEEENGREYKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDTSVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSER

SEQ ID NO: 867057 - protein, 739 aa, Homo sapiens
ESECKAYNPRPVCKTYTMDKQPLNTGGQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEEENGREYKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDTSVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSERHLTLSQTDMAALTGGKGFPFLFQHIRDGINIRQTCNLIFSLCRYNNRLAEHIVSMLFTSIAKLTPEAANPFFKLLTMLMEFAGGPPGMPPFASYILQRIWEVIEYNPSQCLDWLAVQTPRNKLAHSWVLQNMENWVERFLLAHNYPRVRTCKSNI

SEQ ID NO: 867058 - protein, 348 aa, Homo sapiens [sequence omitted]

SEQ ID NO: 867059 - protein, 281 aa, Homo sapiens
RSVKRESYSRIRHPSEIPKHVLLLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 867060 - protein, 299 aa, Homo sapiens
ESECKAYNPRPVCKTYTMDKQPLNTGGQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEDELEQ

SEQ ID NO: 867061 - protein, 124 aa, Homo sapiens
YSLWRQVSDELLRQLCPCGFGAPVCTFSLHLEHGLTPEERKRQSQTGSLGRGHGANALTGETGEAASPPVLRLLPTGAGFAGHKDGHHPRCLFLSHIGWLLLVCLSPGPVSGMGASVPAPINAD

SEQ ID NO: 867062 - protein, 550 aa, Homo sapiens
YSLWRQVSDELLRQVWVRGSGGSWDWDRGVRRESAIPCYTERWQLLTGCFWGMGCLGLLLLQGKKRVPLPTASQPLGYLLAGNLQTEFNKLGSAEGRGGPWQMWGLEEDRSYQGLRPLCWAFACTIVSQAVVSLWLWCACVHFLPPPGAWANTGGKEKTESDRVSGAPSPLLSNGAGLRASGWGGGGGDPVGAITEEEAGPAPSPEFQRCQCALKPQAGRAQDRILDGGKGQSWKGDYREGERKEGRAMTQSTYRMAGSQSSWAGFLAIPHTPRHRENFGTGGDSTDDLFEIEEPRNQTKKYHMVTLVSDTAMTPIASVDTIAVCLFAGAWGGAMVPMHLLGRLEKPLLLLCCASFLLGLALLGIKTDITPVAYFFLTLGGFFLFAYLLVRFLEWGLRSQLQSMQTESPGPSGNARDNEAFEVPVYEEAVVGLESQCRPQELDQPPPYSTVVIPPAPEEEQPSHPEGSRRAKLEQRRMASEGSMAQEGSPGRAPINLRLRGPRAVSTAPDLQSLAAVPTLEPLTPPPAYDVCFGHPDDDSVFYEDNWAPP

SEQ ID NO: 867063 - protein, 181 aa, Homo sapiens
YSLWRQVSDELLRQLCPCGFGAPVCTFSLHLEHGLTPEERKRQSQTGDNEAFEVPVYEEAVVGLESQCRPQELDQPPPYSTVVIPPAPEEEQPSHPEGSRRAKLEQRRMASEGSMAQEGSPGRAPINLRLRGPRAVSTAPDLQSLAAVPTLEPLTPPPAYDVCFGHPDDDSVFYEDNWAPP

SEQ ID NO: 867064 - protein, 216 aa, Homo sapiens
MVPMHLLGRLEKPLLLLCCASFLLGLALLGIKTDITPVAYFFLTLGGFFLFAYLLVRFLEWGLRSQLQSMQTESPGPSGNARDNEAFEVPVYEEAVVGLESQCRPQELDQPPPYSTVVIPPAPEEEQPSHPEGSRRAKLEQRRMASEGSMAQEGSPGRAPINLRLRGPRAVSTAPDLQSLAAVPTLEPLTPPPAYDVCFGHPDDDSVFYEDNWAPP

SEQ ID NO: 867065 - protein, 436 aa, Homo sapiens
YSLWRQVSDELLRQVWVRGSGGSWDWDRGVRRESAIPCYTERWQLLTGCFWGMGCLGLLLLQGKKRVPLPTASQPLGYLLAGNLQTEFNKLGSAEGRGGPWQMWGLEEDRSYQGLRPLCWAFACTIVSQAVVSLWLWCACVHFLPPPGAWANTGGKEKTESDRVSGAPSPLLSNGAGLRASGWGGGGGDPVGAITEEEAGPAPSPEFQRCQCALKPQAGRAQDRILDGGKGQSWKGDYREGERKEGRAMTQSTYRMAGSQSSWAGFLAIPHTPRHRENFGTGGDSTDDLFEIEEPRNQTKKYHMVTLVSDTAMTPIASVDTIAVCLFAGAWGGAMVPMHLLGRLEKPLLLLCCASFLLGLALLGIKTDITPVAYFFLTLGGFFLFAYLLVRFLEWGLRSQLQSMQTESPGPSGNARELRVGIVRGIHLGPILPLSL

SEQ ID NO: 867066 - protein, 216 aa, Homo sapiens; identical to SEQ ID NO: 867064

SEQ ID NO: 867067 - protein, 165 aa, Homo sapiens
YSLWRQVSDELLRQVWVRGSGGSWDWDRGVRRESAIPCYTERWQLLTGCFWGMGCLGLLLLQGKKRVPLPTASQPLGYLLAGNLQTEFNKLGSAEGRGGPWQMWGLEEDRSYQGLRPLCWAFACTIVSQAVVSLWLWCACVHFLPPPGAWANTGGKEKTESDRGQ

SEQ ID NO: 867068 - protein, 216 aa, Homo sapiens; identical to SEQ ID NO: 867064

SEQ ID NO: 867069 - protein, 579 aa, Homo sapiens
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLSKSGLKGCVYGQEAVRLSVGPMARDVESLALCLRALLCEDMFRLDPTVPPLPFREEVYTSSQPLRVGYYETDNYTMPSPAMRRAVLETKQSLEAAGHTLVPFLPSNIPHALETLSTGGLFSDGGHTFLQNFKGDFVDPCLGDLVSILKLPQWLKGLLAFLVKPLLPRLSAFLSNMKSRSAGKLWELQHEIEVYRKTVIAQWRALDLDVVLTPMLAPALDLNAPGRATGAVSYTMLYNCLDFPAGVVPVTTVTAEDEAQMEHYRGYFGDIWDKMLQKGMKKSVGLPVAVQCVALPWQEELCLRFMREVERLMTPEKQSS

SEQ ID NO: 867070 - protein, 582 aa, Homo sapiens
EENNIFKRSRKKERQILPVLQVQLLAAGLLATKPGGHVVYSTCSLSHLQNEYVVQGAIELLANQYSIQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLSKSGLKGCVYGQEAVRLSVGPMARDVESLALCLRALLCEDMFRLDPTVPPLPFREEVYTSSQPLRVGYYETDNYTMPSPAMRRAVLETKQSLEAAGHTLVPFLPSNIPHALETLSTGGLFSDGGHTFLQNFKGDFVDPCLGDLVSILKLPQWLKGLLAFLVKPLLPRLSAFLSNMKSRSAGKLWELQHEIEVYRKTVIAQWRALDLDVVLTPMLAPALDLNAPGRATGAVSYTMLYNCLDFPAGVVPVTTVTAEDEAQMEHYRGYFGDIWDKMLQKGMKKSVGLPVAVQCVALPWQEELCLRFMREVERLMTPEKQSS

SEQ ID NO: 867071 - protein, 297 aa, Homo sapiens [sequence omitted]

SEQ ID NO: 867072 - protein, 563 aa, Homo sapiens
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLSKSGLKGCVYGQEAVRLSVGPMARDVESLALCLRALLCEDMFRLDPTVPPLPFREEVYTSSQPLRVGYYETDNYTMPSPAMRRAVLETKQSLEAAGHTLVPFLPSNIPHALETLSTGGLFSDGGHTFLQNFKGDFVDPCLGDLVSILKLPQWLKGLLAFLVKPLLPRLSAFLSNMKSRSAGKLWELQHEIEVYRKTVIAQWRALDLDVVLTPMLAPALDLNAPGRATGVVPVTTVTAEDEAQMEHYRGYFGDIWDKMLQKGMKKSVGLPVAVQCVALPWQEELCLRFMREVERLMTPEKQSS

SEQ ID NO: 867073 - protein, 144 aa, Homo sapiens [sequence omitted]

SEQ ID NO: 867074 - protein, 579 aa, Homo sapiens; identical to SEQ ID NO: 867069

SEQ ID NO: 867075 - protein, 579 aa, Homo sapiens; identical to SEQ ID NO: 867069

SEQ ID NO: 867076 - protein, 273 aa, Homo sapiens
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLSSTPMWQPMGMT

SEQ ID NO: 867077 - protein, 469 aa, Homo sapiens
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCLVPFLPSNIPHALETLSTGGLFSDGGHTFLQNFKGDFVDPCLGDLVSILKLPQWLKGLLAFLVKPLLPRLSAFLSNMKSRSAGKLWELQHEIEVYRKTVIAQWRALDLDVVLTPMLAPALDLNAPGRATGAVSYTMLYNCLDFPAGVVPVTTVTAEDEAQMEHYRGYFGDIWDKMLQKGMKKSVGLPVAVQCVALPWQEELCLRFMREVERLMTPEKQSS

SEQ ID NO: 867078 - protein, 286 aa, Homo sapiens
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLRSTPALSPCVWGTMRLTTIPCPPRP

SEQ ID NO: 867079 - protein, 235 aa, Homo sapiens
MFGRRELSLVRRRWTGSLHREWDCCGPGEQAGKDVGMGVPGPSILFPSKGDFVDPCLGDLVSILKLPQWLKGLLAFLVKPLLPRLSAFLSNMKSRSAGKLWELQHEIEVYRKTVIAQWRALDLDVVLTPMLAPALDLNAPGRATGAVSYTMLYNCLDFPAGVVPVTTVTAEDEAQMEHYRGYFGDIWDKMLQKGMKKSVGLPVAVQCVALPWQEELCLRFMREVERLMTPEKQSS

SEQ ID NO: 867080 - protein, 148 aa, Homo sapiens
VTTLLLPSSAGKLWELQHEIEVYRKTVIAQWRALDLDVVLTPMLAPALDLNAPGRATGAVSYTMLYNCLDFPAGVVPVTTVTAEDEAQMEHYRGYFGDIWDKMLQKGMKKSVGLPVAVQCVALPWQEELCLRFMREVERLMTPEKQSS

SEQ ID NO: 867081 - protein, 474 aa, Homo sapiens
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLSRYGGWRALLGPSLCDLGLASNLSGLQAGIRSPGFCWEEALQYHWPGVGPSFQSGECSELLCGCGDGGGWPFPVSSILCFLSSKSGLKGCVYGQEAVRLSVGPMARDVESLALCLRALLCEDMFRLDPTVPPLPFREEVYTSSQPLRVGYYETDNYTMPSPAMRRAVLETKQSLEAAGHTLVPFLPSNIPHALETLSTGGLFSDGGHTFLQNL

SEQ ID NO: 867082 - protein, 116 aa, Homo sapiens
SCSEDPKDFEHHPQTDTAEEPGAVSCRCAWLGTEWKALGQNLHRSLELGRVGGYVSEGCIHLEAPQALHSRSALRLRQMALLAVEGLIGTTFPGVMMEQGRQALAWGPKVGMQLII

SEQ ID NO: 867083 - protein, 171 aa, Homo sapiens
RSSAAAKLRGQKRSGASAAPAASAAAALAPSATRTRRSASQAGSKSQAVEKPPSEKPRLRRSSPRAQEEGPGEPPPPELALLPPPPPPPPTPATPTSSASNLDLGEQRERWETFQKRQKLTSEGAAKLLLDTFEYQGLVKHTGGCHCGAVRFEVWASADLHIFDCKYRNYI

SEQ ID NO: 867084 - protein, 171 aa, Homo sapiens; identical to SEQ ID NO: 867083

SEQ ID NO: 867085 - protein, 118 aa, Homo sapiens
EELCGRQAARAEAVRGLRGPRGLRGRCLGTQRHPPPPTPATPTSSASNLDLGEQRERWETFQKRQKLTSEGAAKLLLDTFEYQGLVKHTGGCHCGAVRFEVWASADLHIFDCKYRNYI

SEQ ID NO: 867086 - protein, 171 aa, Homo sapiens; identical to SEQ ID NO: 867083

SEQ ID NO: 867087 - protein, 268 aa, Homo sapiens
RSSAAAKLRGQKRSGASAAPAASAAAALAPSATRTRRSASQAGSKSQAVEKPPSEKPRLRRSSPRAQEEGPGEPPPPELALLPPPPPPPPTPATPTSSASNLDLGEQRERWETFQKRQKLTSEGAAKLLLDTFEYQGLVKHTGGCHCGAVRFEVWASADLHIFDCNCSICKKKQNRHFIVPASRFKLLKGAEHITTYTFNTHKAQHTFCKRCGVQSFYTPRSNPGGFGIAPHCLDEGTVRSMVTEEFNGSDWEKAMKEHKTIKNMSKE

SEQ ID NO: 867088 - protein, 176 aa, Homo sapiens
PGVYRTRSCAGRLLVLGRSGASAAPAASAAAALAPSATRTRRSASQAGSKSQAVEKPPSEKPRLRRSSPRAQEEGPGEPPPPELALLPPPPPPPPTPATPTSSASNLDLGEQRERWETFQKRQKLTSEGAAKLLLDTFEYQGLVKHTGGCHCGAVRFEVWASADLHIFDCKYRNYI

SEQ ID NO: 867089 - protein, 171 aa, Homo sapiens; identical to SEQ ID NO: 867083

SEQ ID NO: 867090 - protein, 385 aa, Homo sapiens
TAAPSVRSARAAAPHLRPVPTALSCRPHLQPRTCRLHLQPRALPGSSMADQAPFDTDVNTLTRFVMEEGRKARGTGELTQLLNSLCTAVKAISSAVRKAGIAHLYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSAQ

SEQ ID NO: 867091 - protein, 395 aa, Homo sapiens
FTRRRLAWPSCTTSAADTRGGSRSVSPPARSRGPHLPPAPAAPHLRPVPTALSCRPHLQPRTCRLHLQPRALPGSSMADQAPFDTDVNTLTRFVMEEGRKARGTGELTQLLNSLYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSAQ

SEQ ID NO: 867092 - protein, 313 aa, Homo sapiens
HILEIQILNSSRILGILRRGLDEGFRRGPSDGYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSAQ

SEQ ID NO: 867093 - protein, 277 aa, Homo sapiens
EIPGVSFLAFSEIATQPGQPFRDVVTTLGPALFWQSGPRFFIWASRLCQRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSAQ

SEQ ID NO: 867094 - protein, 166 aa, Homo sapiens
MLVLAMDCGVNCFMLDPAIGEFILVDKDVKIKKKGKIYSLNEGYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSAQ

SEQ ID NO: 867095 - protein, 427 aa, Homo sapiens
FTRRRLAWPSCTTSAADTRGGSRSVSPPARSRGPHLPPAPAAPHLRPVPTALSCRPHLQPRTCRLHLQPRALPGSSMADQAPFDTDVNTLTRFVMEEGRKARGTGELTQLLNSLCTAVKAISSAVRKAGIAHLYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHFCLTQQYPDLLCTLHS

SEQ ID NO: 867096 - protein, 414 aa, Homo sapiens
FTRRRLAWPSCTTSAADTRGGSRSVSPPARSRGPHLPPAPAAPHLRPVPTALSCRPHLQPRTCRLHLQPRALPGSSMADQAPFDTDVNTLTRFVMEEGRKARGTGELTQLLNSLCTAVKAISSAVRKAGIAHLYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSAQ

SEQ ID NO: 867097 - protein, 280 aa, Homo sapiens
REDPALQRQGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSAQ

SEQ ID NO: 867098 - protein, 333 aa, Homo sapiens
FTRRRLAWPSCTTSAADTRGGSRSVSPPARSRGPHLPPAPAAPHLRPVPTALSCRPHLQPRTCRLHLQPRALPGSSMADQAPFDTDVNTLTRFVMEEGRKARGTGELTQLLNSLCTAVKAISSAVRKAGIAHLYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKVSTSRGRSSPQIIQLLMGPGMWAPWWLMFIALWSTEGYFCTPLTRRAPMES

SEQ ID NO: 867099 - protein, 134 aa, Homo sapiens
MDVESKKLEETPRKLSFLFSAILILAGLNLQDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSAQ

SEQ ID NO: 867100 - protein, 2313 aa, Homo sapiens
PEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNYEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKHNTTSAKGFLSPGSRSPKFKSSKKCLISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLVAQISALALQLDSEDLHNYSGSQLFEMHEKLSCMANSVIKNLQSRWRSPSHENSI

SEQ ID NO: 867101 - protein, 2287 aa, Homo sapiens
PEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNYEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLVAQISALALQLDSEDLHNYSGSQLFEMHEKLSCMANSVIKNLQSRWRSPSHENSI

SEQ ID NO: 867102 - protein, 2287 aa, Homo sapiens; identical to SEQ ID NO: 867101

SEQ ID NO: 867103 - protein, 2313 aa, Homo sapiens; identical to SEQ ID NO: 867100

SEQ ID NO: 867104 - protein, 2313 aa, Homo sapiens; identical to SEQ ID NO: 867100

SEQ ID NO: 867105 - protein, 1825 aa, Homo sapiens
MWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNYEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKHNTTSAKGFLSPGSRSPKFKSSKKCLISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLVAQISALALQLDSEDLHNYSGSQLFEMHEKLSCMANSVIKNLQSRWRSPSHENSI

SEQ ID NO: 867106 - protein, 337 aa, Homo sapiens
PEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEKKKKMLGGGHRNLNHSWGAVVGRLTSRTGREGFHTKAG

SEQ ID NO: 867107 - protein, 179 aa, Homo sapiens
PEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTPKVAKNWSHTTCMFPAEVKQGYALPFCFSSHTLNRCPFYNPCNATFFTFLCFSWWFHCLNLEPKAWVQVLSSLCS

SEQ ID NO: 867108 - protein, 2287 aa, Homo sapiens; identical to SEQ ID NO: 867101

SEQ ID NO: 867109 - protein, 2313 aa, Homo sapiens; identical to SEQ ID NO: 867100

SEQ ID NO: 867110 - protein, 2287 aa, Homo sapiens; identical to SEQ ID NO: 867101

SEQ ID NO: 867111 - protein, 2313 aa, Homo sapiens; identical to SEQ ID NO: 867100

SEQ ID NO: 867112 - protein, 426 aa, Homo sapiens
PEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNASILNVI

SEQ ID NO: 867113 - protein, 142 aa, Homo sapiens
AGDAQPGLVECGSLLRTPGAGAALAAPGLAECSAPEGQCLRSVRGPAPRVGGEAAAQSPHATPPAPSFRVARFRPPRPPFCSRGSAAVGWEPKRESRGICGRRHAVVPAAGGGGVLEQPEPEHGGAQHPQQTGIQRPILSLL

SEQ ID NO: 867114 - protein, 194 aa, Homo sapiens
MPSSPLRVAVVCSSNQNRSMEAHNILSKRGFSVRSFGTGTHVKLPGPAPDKPNVYDFKTTYDQMYNDLLRKDKELYTQNGILHMLDRNKRIKPRPERFQNCKDLFDLILTCEERVYDQVVEDLNSREQETCQPVHVVNVDIQDNHEEATLGAFLICELCQCIQHTEDMENEIDELLQEFEEKSGRTFLHTVCFY

SEQ ID NO: 867115 - protein, 194 aa, Homo sapiens; identical to SEQ ID NO: 867114

SEQ ID NO: 867116 - protein, 167 aa, Homo sapiens
KLLTPTCSHGTGTHVKLPGPAPDKPNVYDFKTTYDQMYNDLLRKDKELYTQNGILHMLDRNKRIKPRPERFQNCKDLFDLILTCEERVYDQVVEDLNSREQETCQPVHVVNVDIQDNHEEATLGAFLICELCQCIQHTEDMENEIDELLQEFEEKSGRTFLHTVCFY

SEQ ID NO: 867117 - protein, 122 aa, Homo sapiens
MISYTQNGILHMLDRNKRIKPRPERFQNCKDLFDLILTCEERVYDQVVEDLNSREQETCQPVHVVNVDIQDNHEEATLGAFLICELCQCIQHTEDMENEIDELLQEFEEKSGRTFLHTVCFY

SEQ ID NO: 867118 - protein, 130 aa, Homo sapiens
MFMISCTMIFLGKTKNSIHRMGFYICWTEIRERFQNCKDLFDLILTCEERVYDQVVEDLNSREQETCQPVHVVNVDIQDNHEEATLGAFLICELCQCIQHTEDMENEIDELLQEFEEKSGRTFLHTVCFY

SEQ ID NO: 867119 - protein, 105 aa, Homo sapiens
MNDSLKLHRYTIKADHKREEHQSSSWLRDGFATPRAQTWETCQPVHVVNVDIQDNHEEATLGAFLICELCQCIQHTEDMENEIDELLQEFEEKSGRTFLHTVCFY

SEQ ID NO: 867120 - protein, 195 aa, Homo sapiens
VETGFHHVGQAGLELLSSSDPPASASQSAGITGESHRARPIFQADGPCVELAVEQGGLVFSDGEGSQCQSRFTPGLAGGWGVPDQLVLSWRFAQVSSNHQRLRFEAHSLCSPNCRVQKPLGLGWACSRQSWGLSHIDCLFPGFGASDVCVTLSQSDLNSREQETCQPVHVVNVDIQDNHEEATLGAFLICELCQC

SEQ ID NO: 867121 - protein, 194 aa, Homo sapiens; identical to SEQ ID NO: 867114

SEQ ID NO: 867122 - protein, 146 aa, Homo sapiens
SRGVPNLSLRAHFHYVLSIGAVFAIIGGFIHCFPLFSGYTLEQTYAKIHFTIIFIGVNLTFFPQHFLGLSGMPRRYSDYPNEDLNLSVVNVDIQDNHEEATLGAFLICELCQCIQHTEDMENEIDELLQEFEEKSGRTFLHTVCFY

SEQ ID NO: 867123 - protein, 194 aa, Homo sapiens; identical to SEQ ID NO: 867114

SEQ ID NO: 867124 - protein, 121 aa, Homo sapiens
NLSASTSLCYSDEGNKRIKPRPERFQNCKDLFDLILTCEERVYDQVVEDLNSREQETCQPVHVVNVDIQDNHEEATLGAFLICELCQCIQHTEDMENEIDELLQEFEEKSGRTFLHTVCFY

SEQ ID NO: 867125 - protein, 228 aa, Homo sapiens
MISCTMIFLGKTKNSIHRMGFYICWTEIRERFQNCKDLFDLILTCEERVYDQVVEGRPASPCTWSMWTSRTTTRRPPWGRFSSVSSASVSSTRKTWRTRSTSCCRSSRRRVAAPFCTPSASTEPSPPLELPVVHTFSFLTFVFTYRCSAGDGSITQINYAKTPDESNQVSSFPLLLMSRILITKFFFFNQKGKTTVCVHFPTYLCLRVPAFPPSSPPGRTVQSPAAAC

SEQ ID NO: 867126 - protein, 211 aa, Homo sapiens
STYLSHQSDLRPERDGPFLLPVLSSLLYHPGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQKRHRSQRELRWRHGGQLLSHQQPARHRLHHQWSPVPRATQCLHPAERGELHQWLPGHEPPHRIWRALDPG

SEQ ID NO: 867127 - protein, 187 aa, Homo sapiens
STYLSHQSDLRPERDGPFLLPVLSSLLYHPGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQKRHRSQRELRWRHGGQLLSHQQPARHRLHHQWSPSGTPGSQWSPPG

SEQ ID NO: 867128 - protein, 187 aa, Homo sapiens
MNGEAIACAEGCQAIVDTGTSLLTGPTSPIANIQKRHRSQRELRWRHGGQLLSHQQPARHRLHHQWSPVPRATQCLHPAERGELHQWLPGHEPPHRIWRALDPVSGEVVPKGTPAGPVDLKDGDPGGEHYSPEEDAHSWAPDIAFDFGSVLCRLRQGKASRKNQKDVDQPETRQESTPPPDTPRDKG

SEQ ID NO: 867129 - protein, 104 aa, Homo sapiens [sequence omitted]

SEQ ID NO: 867130 - protein, 124 aa, Homo sapiens
SSWYLPVPSTVRQITVYSITMNGEAIACAEGCQAIVDTGTSLLTGPTSPIANIQKRHRSQRELRWRHGGQLLSHQQPARHRLHHQWSPVPRATQCLHPAERGELHQWLPGHEPPHRIWRALDPG

SEQ ID NO: 867131 - protein, 211 aa, Homo sapiens; identical to SEQ ID NO: 867126

SEQ ID NO: 867132 - protein, 211 aa, Homo sapiens; identical to SEQ ID NO: 867126

SEQ ID NO: 867133 - protein, 211 aa, Homo sapiens; identical to SEQ ID NO: 867126

SEQ ID NO: 867134 - protein, 211 aa, Homo sapiens; identical to SEQ ID NO: 867126

SEQ ID NO: 867135 - protein, 153 aa, Homo sapiens
TYTNSSWYLSPLALSTLALHHWLSLHTGSLNWVPVTVEGYWQITVDSITMNGEAIACAEGCQAIVDTGTSLLTGPTSPIANIQKRHRSQRELRWRHGGQLLSHQQPARHRLHHQWSPVPRATQCLHPAERGELHQWLPGHEPPHRIWRALDPG

SEQ ID NO: 867136 - protein, 210 aa, Homo sapiens
STYLSHQSDLRPERDGPFLLPVLSSLLYHPGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQKRHRSQRELRWRHGGQLLSHQQPARHRLHHQWSPGRPMGARKAGIFQTKKPFSGGLNEPSANGAPFNRA

SEQ ID NO: 867137 - protein, 130 aa, Homo sapiens
HIRTRVGTSLHTGSLNWVPVTVEGYWQITVDSITMNGEAIACAEGCQAIVDTGTSLLTGPTSPIANIQKRHRSQRELRWRHGGQLLSHQQPARHRLHHQWSPVPRATQCLHPAGCPKASSGRTETSSVER

SEQ ID NO: 867138 - protein, 149 aa, Homo sapiens
SPLTFHSDDQSGSVVIFGGIDSSYYTGSLNWVPVTVEGYWQITVDSITMNGEAIACAEGCQAIVDTGTSLLTGPTSPIANIQKRHRSQRELRWRHGGQLLSHQQPARHRLHHQWSPLQSGSRKCDRNKDRENVNKQIRKNRNTGRSGML

SEQ ID NO: 867139 - protein, 138 aa, Homo sapiens
HIRTRVGTSLHTGSLNWVPVTVEGYWQITVDSITMNGEAIACAEGCQAIVDTGTSLLTGPTSPIANIQKRHRSQRELRWRHGGQLLSHQQPARHRLHHQWSPVPRATQCLHPAERGELHQWLPGHEPPHRIWRALDPG

SEQ ID NO: 867140 - protein, 153 aa, Homo sapiens; identical to SEQ ID NO: 867135

SEQ ID NO: 867141 - protein, 211 aa, Homo sapiens; identical to SEQ ID NO: 867126

SEQ ID NO: 867142 - protein, 98 aa, Homo sapiens
TYSNRVGTEQRELRLDMVVSCSAISSLPDIVFTINGVQYPVPPSAYILQSEGSCISGFQGMNLPTESGELWILGDVFIRQYFTVFDRANNQVGLAPVA

SEQ ID NO: 867143 - protein, 186 aa, Homo sapiens
STYLSHQSDLRPERDGPFLLPVLSSLLYHPGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQKRHRSQRELRWRHGGQLLSHQQPARHRLHHQWSPVERGYQLESYM

SEQ ID NO: 867144 - protein, 116 aa, Homo sapiens
STYLSHQSDLRPERDGPFLLPVLSSLLYHPGLAYPSISSSGATPVFDNIWNQGLVSQDLFSVYLSADDQSGSVVIFGGIDSSYYTGSLNWVPVTVEGYWQITVDRWREGTNSSRIC

SEQ ID NO: 867145 - protein, 174 aa, Homo sapiens
MTSEVIEDEKQFYSKAKTYWKQIPPTVDGMLGGYGHISSIDINSSRKFLQRFLREGPNKTGTSCALDCGAGIGRITKRLLLPLFREVDMVDITEDFLVQAKTYLGEEGKRVRNYFCCGLQDFTPEPDSYDVIWIQWVIGEGSTALPCSPVCLLPLAFPIRCQDQGFALLQQVGQ

SEQ ID NO: 867146 - protein, 141 aa, Homo sapiens [sequence omitted]

SEQ ID NO: 867147 - protein, 223 aa, Homo sapiens
MTSEVIEDEKQFYSKAKTYWKQIPPTVDGMLGGYGHISSIDINSSRKFLQRFLREGPNKTGTSCALDCGAGIGRITKRLLLPLFREVDMVDITEDFLVQAKTYLGEEGKRVRNYFCCGLQDFTPEPDSYDVIWIQWVIGHLTDQHLAEFLRRCKGSLRPNGIIVIKDNMAQEGVILDDVDSSVCRDLDVVRRIICSAGLSLLAEERQENLPDEIYHVYSFALR

SEQ ID NO: 867148 - protein, 223 aa, Homo sapiens; identical to SEQ ID NO: 867147

SEQ ID NO: 867149 - protein, 223 aa, Homo sapiens; identical to SEQ ID NO: 867147

SEQ ID NO: 867150 - protein, 135 aa, Homo sapiens
MVDITEDFLVQAKTYLGEEGKRVRNYFCCGLQDFTPEPDSYDVIWIQWVIGHLTDQHLAEFLRRCKGSLRPNGIIVIKDNMAQEGVILDDVDSSVCRDLDVVRRIICSAGLSLLAEERQENLPDEIYHVYSFALR

SEQ ID NO: 867151 - protein, 223 aa, Homo sapiens; identical to SEQ ID NO: 867147

SEQ ID NO: 867152 - protein, 135 aa, Homo sapiens; identical to SEQ ID NO: 867150

SEQ ID NO: 867153 - protein, 145 aa, Homo sapiens
MTSEVIEDEKQFYSKAKTYWKQIPPTVDGMLGGYGHISSIDINSSRKFLQRFLREGPNKTGTSCALDCGAGIGRITKRLLLPLFREVDMVDITEDFLVQAKTYLGEEGKRATSPISTWPSSCGAARAASAPTASSSSKTTWPRRA

SEQ ID NO: 867154 - protein, 174 aa, Homo sapiens; identical to SEQ ID NO: 867145

SEQ ID NO: 867155 - protein, 83 aa, Homo sapiens
KRRRGKCSLKLFRQMWVRDSWAGHSLGSAPCASSSRVTWKQKRLIIWASSLSPPTVSPSRKMMQVNTVSPSLVVALTSAPRRA

SEQ ID NO: 867156 - protein, 223 aa, Homo sapiens; identical to SEQ ID NO: 867147

SEQ ID NO: 867157 - protein, 223 aa, Homo sapiens; identical to SEQ ID NO: 867147

SEQ ID NO: 867158 - protein, 174 aa, Homo sapiens; identical to SEQ ID NO: 867145

SEQ ID NO: 867159 - protein, 145 aa, Homo sapiens; identical to SEQ ID NO: 867153

SEQ ID NO: 867160 - protein, 135 aa, Homo sapiens; identical to SEQ ID NO: 867150

SEQ ID NO: 867161 - protein, 145 aa, Homo sapiens; identical to SEQ ID NO: 867153

SEQ ID NO: 867162 - protein, 145 aa, Homo sapiens; identical to SEQ ID NO: 867153

SEQ ID NO: 867163 - protein, 174 aa, Homo sapiens; identical to SEQ ID NO: 867145

SEQ ID NO: 867164 - protein, 241 aa, Homo sapiens
MQKIFAREILDSRGNPTVEVDLHTAKGRFRAAVPSGASTGIYEALELRDGDKGRYLGKGVLKAVENINSTLGPALLQKKLSVADQEKVDKFMIELDGTENKSKFGANAILGVSLAVCKAGAAEKGVPLYRHIADLAGNPDLILPVPAFNVINGGSHAGNKLAMQEFMILPVGASLQSMGARSTHSGVIRQFGRCPWVRRVRPLGKEAGVKGPGVPQGPLMAGPEENETERAGNDENTGQRE

SEQ ID NO: 867165 - protein, 180 aa, Homo sapiens
MQKIFAREILDSRGNPTVEVDLHTAKGRFRAAVPSGASTGIYEALELRDGDKGRYLGKGVLKAVENINSTLGPALLQKKLSVADQEKVDKFMIELDGTENKSKFGANAILGVSLAVCKAGAAEKGVPLYRHIADLAGNPDLILPVPVSAATRPSQISPGQSQPRPARVGPPGKSTFQTSS

SEQ ID NO: 867166 - protein, 138 aa, Homo sapiens
MLNSPSCSSESRIKAGPTASPGNSSYEPTPKGGYQKRGLPGPKRASGPSLSLRSQHQGYMGSQQVSMGYSLYNLRNLMSTLRSQGWVSGHPREPEVGGKHAMLPAIAPPVGARKKSPRGPEPRARAAAKAQGQSYSSA

SEQ ID NO: 867167 - protein, 43 aa, Homo sapiens
MALLLGLLSALLLGPRTGLELPRLAGGGRRRARGTRCRPDRGS

SEQ ID NO: 867168 - protein, 280 aa, Homo sapiens
MAMQKIFAREILDSRGNPTVEVDLHTAKGRFRAAVPSGASTGIYEALELRDGDKGRYLGKGVLKAVENINSTLGPALLQKKLSVADQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGDAV

SEQ ID NO: 867169 - protein, 366 aa, Homo sapiens
RATEGPTHVQPPFAPLPGQAPSQGLSLRALDRARPHPSPSLRVQTGAVPRTAQASQYRDVDERFPGDGGPDGGRVLVAHDGRVLTAMAMQKIFAREILDSRGNPTVEVDLHTAKGRFRAAVPSGASTGIYEALELRDGDKGRYLGKGVLKAVENINSTLGPALLQKKLSVADQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGDAV

SEQ ID NO: 867170 - protein, 280 aa, Homo sapiens; identical to SEQ ID NO: 867168

SEQ ID NO: 867171 - protein, 278 aa, Homo sapiens
MQKIFAREILDSRGNPTVEVDLHTAKGRFRAAVPSGASTGIYEALELRDGDKGRYLGKGVLKAVENINSTLGPALLQKKLSVADQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGDAV

SEQ ID NO: 867172 - protein, 289 aa, Homo sapiens
MAVMRTLRAMAMQKIFAREILDSRGNPTVEVDLHTAKGRFRAAVPSGASTGIYEALELRDGDKGRYLGKGVLKAVENINSTLGPALLQKKLSVADQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGDAV

SEQ ID NO: 867173 - protein, 278 aa, Homo sapiens; identical to SEQ ID NO: 867171

SEQ ID NO: 867174 - protein, 278 aa, Homo sapiens; identical to SEQ ID NO: 867171

SEQ ID NO: 867175 - protein, 278 aa, Homo sapiens; identical to SEQ ID NO: 867171

SEQ ID NO: 867176 - protein, 278 aa, Homo sapiens; identical to SEQ ID NO: 867171

SEQ ID NO: 867177 - protein, 74 aa, Homo sapiens
MRSLRGGEGHCPSCHLDSELHPNLQRRHPSHGHAENLCPGNLGLQGQPHGGGGPAHGQGPIPSSCAQWGFHGYL

SEQ ID NO: 867178 - protein, 277 aa, Homo sapiens
MQKIFAREILDSRGNPTVEVDLHTAKGRFRAAVPSGASTGIYEALELRDGDKGRYLGKGVLKAVENINSTLGPALLQKKLSVADQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMVGPWFFAEAVVLVGTPGTGADACLDPGRLAGRAPG

SEQ ID NO: 867179 - protein, 94 aa, Homo sapiens
SDCCVRHQIGSVPNDQCKLAQSNGWGVMVSHRSGETEDTFIADLVVGLCTGQIKTGAPCRSERLAKYNQLMRIEEALGDKAIFAGRKFRNPKAK

SEQ ID NO: 867180 - protein, 43 aa, Homo sapiens; identical to SEQ ID NO: 867167

SEQ ID NO: 867181 - protein, 278 aa, Homo sapiens; identical to SEQ ID NO: 867171

SEQ ID NO: 867182 - protein, 278 aa, Homo sapiens; identical to SEQ ID NO: 867171

SEQ ID NO: 867183 - protein, 187 aa, Homo sapiens
MIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGDAV

SEQ ID NO: 867184 - protein, 235 aa, Homo sapiens
MQKIFAREILDSRGNPTVEVDLHTAKGRFRAAVPSGASTGIYEALELRDGDKGRYLGKAKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGDAV

SEQ ID NO: 867185 - protein, 278 aa, Homo sapiens; identical to SEQ ID NO: 867171

SEQ ID NO: 867186 - protein, 113 aa, Homo sapiens
MIELDGTENKSKFGANATKGRFRAAVPSGASTGIYEALELRDGDKGRYLGKGVLKAVENINSTLGPALLQKIKTGAPCRSERLAKYNQLMRIEEALGDKAIFAGRKFRNPKAK

SEQ ID NO: 867187 - protein, 469 aa, Homo sapiens
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 867188 - protein, 469 aa, Homo sapiens; identical to SEQ ID NO: 867187

SEQ ID NO: 867189 - protein, 469 aa, Homo sapiens; identical to SEQ ID NO: 867187

SEQ ID NO: 867190 - protein, 468 aa, Homo sapiens
RPGIAVVDLLSTGGTYWLLLSGLRGVVDRERYRGVDFIILIITVISASQNEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 867191 - protein, 129 aa, Homo sapiens
MTTCTTICKRTSMATATGTHMKISTMATAMPMAMATLTRASGMDIPTITTMDIHMRIYTMAIAMATPMRASTTGTGGHSADLSSSIFCPLPYPRGVELSPASLSTSDLAQFCFRWAPGRCFPAPHSSCS

SEQ ID NO: 867192 - protein, 264 aa, Homo sapiens
MDTPTGGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 867193 - protein, 241 aa, Homo sapiens
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVCLTMLHLEG

SEQ ID NO: 867194 - protein, 239 aa, Homo sapiens
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSARAPFCLCDRGALATVGVMCLTMLHLEG

SEQ ID NO: 867195 - protein, 469 aa, Homo sapiens; identical to SEQ ID NO: 867187

SEQ ID NO: 867196 - protein, 469 aa, Homo sapiens; identical to SEQ ID NO: 867187

SEQ ID NO: 867197 - protein, 394 aa, Homo sapiens
CVVFQRITQIRRLSHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 867198 - protein, 336 aa, Homo sapiens
MTSTCMTVSVSMSMTVTNVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 867199 - protein, 322 aa, Homo sapiens
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTEEESHFLMYFRGRTDRTGLWIGCWERDG

SEQ ID NO: 867200 - protein, 239 aa, Homo sapiens; identical to SEQ ID NO: 867194

SEQ ID NO: 867201 - protein, 459 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 867202 - protein, 69 aa, Homo sapiens
MTAEEMKATESGAQSAPLPMEGVDISPKQDEGVLKVRGGGACGGVGTRGPAGRPSAAPGARGRARVEAA

SEQ ID NO: 867203 - protein, 460 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 867204 - protein, 459 aa, Homo sapiens; identical to SEQ ID NO: 867201

SEQ ID NO: 867205 - protein, 459 aa, Homo sapiens; identical to SEQ ID NO: 867201

SEQ ID NO: 867206 - protein, 459 aa, Homo sapiens; identical to SEQ ID NO: 867201

SEQ ID NO: 867207 - protein, 363 aa, Homo sapiens
CSALSAAPPLSAAPPLSGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 867208 - protein, 459 aa, Homo sapiens; identical to SEQ ID NO: 867201

SEQ ID NO: 867209 - protein, 459 aa, Homo sapiens; identical to SEQ ID NO: 867201

SEQ ID NO: 867210 - protein, 459 aa, Homo sapiens; identical to SEQ ID NO: 867201

SEQ ID NO: 867211 - protein, 317 aa, Homo sapiens
FAFESRYPKQFIQTHGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 867212 - protein, 313 aa, Homo sapiens
LRNPARLNQAHGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 867213 - protein, 345 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKLYANMFERLAEEENKAKAEASSGDHPTDTEMKEEQKSNTAGSQSQVETEA

SEQ ID NO: 867214 - protein, 459 aa, Homo sapiens; identical to SEQ ID NO: 867201

SEQ ID NO: 867215 - protein, 198 aa, Homo sapiens
LPAVLLFCSSFIPVSVGWSPEEASALALFSSSASLSSILEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 867216 - protein, 415 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLFSARC

SEQ ID NO: 867217 - protein, 358 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALEQTRTHASQEHR

SEQ ID NO: 867218 - protein, 342 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAGYREL

SEQ ID NO: 867219 - protein, 313 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESVITAWVHYF

SEQ ID NO: 867220 - protein, 112 aa, Homo sapiens
MTAEEMKATESGAQSAPLPMEGVDISPKQDEGVLKVIKREGTGTEMPMIGDRVFVHYTGWLLDGTKFDSSLDRKDKFSFDHPLFPVLVFPLSVSPLGQVVSQNPLSLFSARC

SEQ ID NO: 867221 - protein, 150 aa, Homo sapiens
MTAEEMKATESGAQSAPLPMEGVDISPKQDEGVLKIMGTSSVCSSGSPVACDFPFSLQRPAVFYEIVIQVIKREGTGTEMPMIGDRVFVHYTGWLLDGTKFDSSLDRKDKFSFDLGKGGEVIKAWDIAIATMKVGEVALCLWSSTDDSSR

SEQ ID NO: 867222 - protein, 271 aa, Homo sapiens
PSGAASRGPPRWWRCQGSPTRAVEHGPGRGATPHSAFLALRPLCDAGATGFRRPPGVPCRRRDPARSPLAARRPLPRPRGGRARGMPGAVVPSPLRRLPEPGLRGVGRGGGALLWSLPPSDRSTTNSLGSCGEGILTWARTTCLGSEQVPGRIRDGEFPACVLCLLPIRCCVLILAFPPLSSACAAPTSGGLYLVQKCICLCTRLLGTSSVCSSGSPVACDFPFSLQRPAVFYEIVIPGKLISPLIHHSFPFTFLLLKAPVYSSWKLSLGG

SEQ ID NO: 867223 - protein, 493 aa, Homo sapiens
MTAEEMKATESGAQSAPLPMEGVDISPKQDEGVLKIMGTSSVCSSGSPVACDFPFSLQRPAVFYEIVIQVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 867224 - protein, 414 aa, Homo sapiens
MPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 867225 - protein, 546 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEGETVQSGLSILILIFRPCVALGKTLPFSEPIFLSIKCGVGPYSLHITPDLRTQENLGMMGVMQGGLWHPSSVTCPLTTLVHCLSFMPVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 867226 - protein, 459 aa, Homo sapiens; identical to SEQ ID NO: 867201

SEQ ID NO: 867227 - protein, 290 aa, Homo sapiens [sequence omitted]

SEQ ID NO: 867228 - protein, 446 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSLEKLDSYSSQDTIFL

SEQ ID NO: 867229 - protein, 382 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLRT

SEQ ID NO: 867230 - protein, 314 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESVLTAWGSSRS

SEQ ID NO: 867231 - protein, 312 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESIVFPRGAH

SEQ ID NO: 867232 - protein, 112 aa, Homo sapiens; identical to SEQ ID NO: 867220

SEQ ID NO: 867233 - protein, 99 aa, Homo sapiens
RVTAVQGMPKALPPPPALSAPCLTLPRLSQVLHCTGQVKVYNNCPPHNSLCGYKEPLLSCLIIMCEPIQHPSHMDIPLDSKTFLSRHSMDMKFTYCDDR

SEQ ID NO: 867234 - protein, 870 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNDKFTQNPMRGLGHPLRHLPLPQPPSAISPGENSKSRFPPQCYATQYQDYSLSSAHKVSGMASRLLGPSFESYLLPELTRYDCEVNVPVLGSSTLLQGGDLLRALDQAT

SEQ ID NO: 867235 - protein, 870 aa, Homo sapiens; identical to SEQ ID NO: 867234

SEQ ID NO: 867236 - protein, 768 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNADKFTQ

SEQ ID NO: 867237 - protein, 366 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEVSPSLPQLHGALSCNFFLPY

SEQ ID NO: 867238 - protein, 234 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGILNCVYFLLAPTGWESASPLSTGIREIAHGPCDAGKMDVLNTQKYLLLALHGAWCPTTRGHLWVRTLSLGGFITQESSISAK

SEQ ID NO: 867239 - protein, 103 aa, Homo sapiens
VSNPRLFLKLPHTCAAARTSRFPLSWVSAPHLRQWFWRQTRSPGMQQAVGQTPLKEQSEIRAALLVSPSHKEVDTFPNVRFRPLSYGTNPSFRHGKPAARALI

SEQ ID NO: 867240 - protein, 38 aa, Homo sapiens
MTADKEKKRDTIEESRRLPYCKVSTLVSRQERRKIRGY

SEQ ID NO: 867241 - protein, 809 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNASICHQSRGEQQEQVPPTVLRHPVPGLQPVVSPQGVRHGKPAARALI

SEQ ID NO: 867242 - protein, 735 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSILSAKGFGARGPDVLSPAMVALSNKLKLKRQLEYEEQAFQDLSGGDPPGGSTSHLMWKRMKNLRGGSCPLMPDKPLSANVPNASICHQSRGEQQEQVPPTVLRHPVPGLQPVVSPQGVRHGKPAARALI

SEQ ID NO: 867243 - protein, 172 aa, Homo sapiens
MLGTPYKLKLKRQLEYEEQAFQDLSGGDPPGGSTSHLMWKRMKNLRGGSCPLMPDKPLSANVPNDKFTQNPMRGLGHPLRHLPLPQPPSAISPGENSKSRFPPQCYATQYQDYSLSSAHKVSGMASRLLGPSFESYLLPELTRYDCEVNVPVLGSSTLLQGGDLLRALDQAT

SEQ ID NO: 867244 - protein, 206 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGILNCVYFLLAPTGWESASPLSTGIREIAHGPCDAGKMDVLKKFKYVACEMRLGH

SEQ ID NO: 867245 - protein, 136 aa, Homo sapiens
MTADKEKKRSSSERRKEKSRDAARCRRSKETEVFYELAHELPLPHSVSSHLDKASIMRLAISFLRTHKLLSSAVTFTVNPAVRGGQGQDQGRTWAPRGCGEHGLGEPRTAFADFSICCHLAIRPILHTRLSPQEAF

SEQ ID NO: 867246 - protein, 56 aa, Homo sapiens
PTRKFAYLGRLAHEVGWKYQAVTATLEEKRKEKAKIHYRKKKQLMRLRKQAEKNME

SEQ ID NO: 867247 - protein, 43 aa, Homo sapiens
MVGWKYQAVTATLEEKRKEKAKIHYRKKKQLMRLRKQAEKNME

SEQ ID NO: 867248 - protein, 107 aa, Homo sapiens
MEADASVDMFSKVLEHQLLQTTKLVEEHLDSEIQKLDQMDEDELERLKEKRLQALRKAQQQKQEWLSKGHGEYREIPSERDFFQEVKESEHMWFAISTETPHSGVKY

SEQ ID NO: 867249 - protein, 70 aa, Homo sapiens
GHSTIRTARENPEWTVSLVNTACFLIERISRVDDLKYGLETILKAIVNSCDPSVGQAHGRCLECNTARIE

SEQ ID NO: 867250 - protein, 107 aa, Homo sapiens
MEADASVDMFSKVLEHQLLQTTKLVEEHLDSEIQKLDQMDEDELERLKEKRLQALRKAQQQKQEWLSKGHGEYREIPSERDFFQEVKESEHMWFAISTETPHSALHI

SEQ ID NO: 867251 - protein, 126 aa, Homo sapiens
MEADASVDMFSKVLEHQLLQTTKLVEEHLDSEIQKLDQMDEDELERLKEKRLQALRKAQQQKQEWLSKGHGEYREIPSERDFFQEVKESEHMWFAISTETPHSETTSGICPEHSDLLSDVALPFEV

SEQ ID NO: 867252 - protein, 107 aa, Homo sapiens; identical to SEQ ID NO: 867248

SEQ ID NO: 867253 - protein, 107 aa, Homo sapiens; identical to SEQ ID NO: 867248

SEQ ID NO: 867254 - protein, 107 aa, Homo sapiens; identical to SEQ ID NO: 867248

SEQ ID NO: 867255 - protein, 107 aa, Homo sapiens; identical to SEQ ID NO: 867248

SEQ ID NO: 867256 - protein, 107 aa, Homo sapiens; identical to SEQ ID NO: 867248

SEQ ID NO: 867257 - protein, 154 aa, Homo sapiens
MEADASVDMFSKVLEHQLLQTTKLVEEHLDSEIQKLDQMDEDELERLKEKRLQALRKAQQQKQMESRCDTLAGVQWCHLNSLQPPLPGFKQLFCLSHPSSWDYRRTPPCLEWLSKGHGEYREIPSERDFFQEVKESEHMWFAISTETPHSGVKY

SEQ ID NO: 867258 - protein, 106 aa, Homo sapiens
MEADASVDMFSKVLEHQLLQTTKLVEEHLDSEIQKLDQMDEDELERLKEKRLQALRKAQQQKQEWLSKGHGEYREIPSERDFFQEVKESEHMWFAISTETPHSVEI

SEQ ID NO: 867259 - protein, 162 aa, Homo sapiens
MEADASVDMFSKVLEHQLLQTTKLVEEHLDSEIQKLDQMDEDELERLKEKRLQALRKAQQQKQRMGFLKDIGGRIHEGKIPQVNRDFFFNGKGFPNGGNSQVGTQHLVLWAQLSFPFLNPDSGRPNRGGKYTSSFIPPPQQNHTISRHPNGAGALAVFLHSP

SEQ ID NO: 867260 - protein, 488 aa, Homo sapiens
MVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 867261 - protein, 577 aa, Homo sapiens
KTTAAEKGRVQPSPEVAGGCEDCKRVESASPPPRPRPCREPTFPVLGGGQILASMVAPGLVLGLVLPLILWADRSAGIGFRFASYINNDMVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 867262 - protein, 577 aa, Homo sapiens; identical to SEQ ID NO: 867261

SEQ ID NO: 867263 - protein, 488 aa, Homo sapiens; identical to SEQ ID NO: 867260

SEQ ID NO: 867264 - protein, 748 aa, Homo sapiens
SRILRTKPVESMLEGTGTTTAHGTKLAQVLTTVDLISLGVGSCVGTGMYVVSGLVAKEMAGPGVIVSFIIAAVASILSGVCYAEFGVRVPKTTGSAYTYSYVTVGEFVAFFIGWNLILEYLIGTAAGASALSSMFDSLANHTISRWMADSVGTLNGLGKGEESYPDLLALLIAVIVTIIVALGVKNSIGFNNVLNVLNLAVWVFIMIAGLFFINGKYWAEGQFLPHGWSGVLQGAATCFYAFIGFDIIATTGEEAKNPNTSIPYAITASLVICLTAYVSVSVILTLMVPYYTIDTESPLMEMFVAHGFYAAKFVVAIGSVAGLTVSLLGSLFPMPRVIYAMAGDGLLFRFLAHVSSYTETPVVACIVSGFLAALLALLVSLRDLIEMMSIGTLLAYTLVSVCVLLLRYQPESDIDGFVKFLSEEHTKKKEGILADCEKEACSPVSEGDEFSGPATNTCGAKNLPSLGDNEMLIGKSDKSTYNVNHPNYGTVDMTTGIEADESENIYLIKLKKLIGPHYYTMRIRLGLPGKMDRPTAATGHTVTICVLLLFILMFIFCSFIIFGSDYISEQSWWAILLVVLMVLLISTLVFVILQQPENPKKLPYMAPCLPFVPAFAMLVNIYLMLKLSTITWIRFAVWCFVGLLIYFGYGIWNSTLEISAREEALHQSTYQRYDVDDPFSVEEGFSYATEGESQEDWGGPTEDKGFYYQQMSDAKANGRTSSKAKSKSKHKQNSEALIANDELDYSPE

SEQ ID NO: 867265 - protein, 748 aa, Homo sapiens; identical to SEQ ID NO: 867264

SEQ ID NO: 867266 - protein, 70 aa, Homo sapiens
QRLILERILQLQAKERQELPASTRSWDRRPGQSLPQILQKEATLQHLTETQHFFLFQMERIHQSGMSSYL

SEQ ID NO: 867267 - protein, 518 aa, Homo sapiens
MWRLPGARAALRVIRTAVEKLSRAEAGSQTAAGAMERAVVRCVPSEPKLSLSFALADGSHKNMQRDQSEPLGRVLSRIATNALKGHAKAAAAKKSRKSRPNASGGAACSGPGPEPAVFCEPVVKLYYREEAVAEDVLNVDAWQDGAVLQIGDVKYKVERNPPAFTELQLPRYIMAGFPVCPKLSLEFGDPASSLFRWYKEAKPGAAEPEVGVPSSLSPSSPSSSWTETDVEERVYTPSNADIGLRLKLHCTPGDGQRFGHSRELESVCVVEAGPGTCTFDHRHLYTKKVTEDALIRTVSYNILADTYAQTEFSRTVLYPYCAPYALELDYRQNLIQKELTGYNADVICLQEVDRAVFSDSLVPALEAFGLEGVFRIKQHEGLATFYRKSKFSLLSQHDISFYEALESDPLHKELLEKLVLYPSAQEKVLQRSSVLQVSVLQSTKDSSKRICVANTHLYWHPKGGYIRLIQMAVALAHIRHVSCDLYPGIPVIFCGDFNSTPSTGMFHFVINGSIPRGS

SEQ ID NO: 867268 - protein, 518 aa, Homo sapiens; identical to SEQ ID NO: 867267

SEQ ID NO: 867269 - protein, 518 aa, Homo sapiens; identical to SEQ ID NO: 867267

SEQ ID NO: 867270 - protein, 518 aa, Homo sapiens; identical to SEQ ID NO: 867267

SEQ ID NO: 867271 - protein, 472 aa, Homo sapiens
MWRLPGARAALRVIRTAVEKLSRAEAGSQTAAGAMERAVVRCVPSEPKLSLSFALADGSHKNMQRDQSEPLGRVLSRIATNALKGHAKAAAAKKSRKSRPNASGGAACSGPGPEPAVFCEPVVKLYYREEAVAEDVLNVDAWQDGAVLQIGDVKYKVERNPPAFTELQLPRYIMAGFPVCPKLSLEFGDPASSLFRWLRLKLHCTPGDGQRFGHSRELESVCVVEAGPGTCTFDHRHLYTKKVTEDALIRTVSYNILADTYAQTEFSRTVLYPYCAPYALELDYRQNLIQKELTGYNADVICLQEVDRAVFSDSLVPALEAFGLEGVFRIKQHEGLATFYRKSKFSLLSQHDISFYEALESDPLHKELLEKLVLYPSAQEKVLQRSSVLQVSVLQSTKDSSKRICVANTHLYWHPKGGYIRLIQMAVALAHIRHVSCDLYPGIPVIFCGDFNSTPSTGMFHFVINGSIPRGS

SEQ ID NO: 867272 - protein, 518 aa, Homo sapiens; identical to SEQ ID NO: 867267

SEQ ID NO: 867273 - protein, 779 aa, Homo sapiens
MTHTRRKSLPMLSSGLTGRREPLQMEDSNMEQGVEGVEPGMPESPGHLTGRRKNYPLRKRPLVPEKPKACKVLLTRLENVAGPRSADEADELPPDLPKPPSPAPSSEDPGLAQPRKRRLASLNAEALNNLLLEREDTSSLAGTRRSRAGDPHRSRDRDRATGGWSSSKKRPRLGDLGGGSRDLSPEPAPDEGPRRDGDPAPKRLASLNAAAFLKLSQERELPLRLPRAHAEVDGRSTEPPAPKAPRPKWPKVNGKNYPKAWQGASSGEAAGPPGWQGCPDEPWPSATPCGPSVQPSHKPLSKALESPLGLRPHLPLLMGGQAALKPEPGRPGEESPAPKQELHQPSFPTPQLSPLPMPGNPADYNGLCVGPELTALGSFYLYCGQEGLQCGGYSPCPMLPEGKLSPVAAPHEEGLLLAPSSVPSGTPFQHPPWGSSRYCSSEDTGVNGYSICGVLPLSVTHAGTTCGGCPYKMPFAAGCRSLGQLEFPLPEAGHPASPAHPLLGCPVPSVPPAAEPVPHLQTPTSEPQTVARACPQSAKPPSGSKSGLRTGSSCRHTARSKAARRPSHPKQPRVQRPRPRRRRRRRTNGWVPVGAACEKAVYVLDEPEPAIRKSYQAVERHGETIRVRDTVLLKSGPRKTSTPYVAKISALWENPESGELMMSLLWYYRPEHLQGGRSPSMHEPLQNEVFASRHQDQNSVACIEEKCYVLTFAEYCRFCAMAKRRGEGLPSRKTALVPPSADYSTPPHRTVPEDTDPELVFLCRHVYDFRHGRILKNPQ

SEQ ID NO: 867274 - protein, 560 aa, Homo sapiens
RPGPAGAQSRAVRAARSGWKYSMTHTRRKSLPMLSSGLTGRREPLQMEDSNMEQGVEGVEPGMPESPGHLTGRRKNYPLRKRPLVPEKPKACKVLLTRLENVAGPRSADEADELPPDLPKPPSPAPSSEDPGLAQPRKRRLASLNAEALNNLLLEREDTSSLAGTRRSRAGDPHRSRDRDRATGGWSSSKKRPRLGDLGGGSRDLSPEPAPDEGPRRDGDPAPKRLASLNAAAFLKLSQERELPLRLPRAHAEVDGRSTEPPAPKAPRPKWPKVNGKNYPKAWQGASSGEAAGPPGWQGCPDEPWPSATPCGPSVQPSHKPLSKALESPLGLRPHLPLLMGGQAALKPEPGRPGEESPAPKQELHQPSFPTPQLSPLPMPGNPADYNGLCVGPELTALGSFYLYCGQEGLQCGGYSPCPMLPEGKLSPVAAPHEEGLLLAPSSVPSGTPFQHPPWGSSRYCSSEDTGVNGYSICGVLPLSVTHAGTTCGGCPYKMPFAAGCRSLGQLEFPLPEAGHPASPAHPLLGCPVPSVPPAAEPVPHLLILNKLFGGRCLSGRMGQ

SEQ ID NO: 867275 - protein, 43 aa, Homo sapiens
MTHTRRKSLPMLSSGLTGRREPLQMEDSNMEQGVEGVEPGMPE

SEQ ID NO: 867276 - protein, 801 aa, Homo sapiens
RPGPAGAQSRAVRAARSGWKYSMTHTRRKSLPMLSSGLTGRREPLQMEDSNMEQGVEGVEPGMPESPGHLTGRRKNYPLRKRPLVPEKPKACKVLLTRLENVAGPRSADEADELPPDLPKPPSPAPSSEDPGLAQPRKRRLASLNAEALNNLLLEREDTSSLAGTRRSRAGDPHRSRDRDRATGGWSSSKKRPRLGDLGGGSRDLSPEPAPDEGPRRDGDPAPKRLASLNAAAFLKLSQERELPLRLPRAHAEVDGRSTEPPAPKAPRPKWPKVNGKNYPKAWQGASSGEAAGPPGWQGCPDEPWPSATPCGPSVQPSHKPLSKALESPLGLRPHLPLLMGGQAALKPEPGRPGEESPAPKQELHQPSFPTPQLSPLPMPGNPADYNGLCVGPELTALGSFYLYCGQEGLQCGGYSPCPMLPEGKLSPVAAPHEEGLLLAPSSVPSGTPFQHPPWGSSRYCSSEDTGVNGYSICGVLPLSVTHAGTTCGGCPYKMPFAAGCRSLGQLEFPLPEAGHPASPAHPLLGCPVPSVPPAAEPVPHLQTPTSEPQTVARACPQSAKPPSGSKSGLRTGSSCRHTARSKAARRPSHPKQPRVQRPRPRRRRRRRTNGWVPVGAACEKAVYVLDEPEPAIRKSYQAVERHGETIRVRDTVLLKSGPRKTSTPYVAKISALWENPESGELMMSLLWYYRPEHLQGGRSPSMHEPLQNEVFASRHQDQNSVACIEEKCYVLTFAEYCRFCAMAKRRGEGLPSRKTALVPPSADYSTPPHRTVPEDTDPELVFLCRHVYDFRHGRILKNPQ

SEQ ID NO: 867277 - protein, 801 aa, Homo sapiens; identical to SEQ ID NO: 867276

SEQ ID NO: 867278 - protein, 558 aa, Homo sapiens
SLECSSYSMPRIPASPLSCCPPDMLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 867279 - protein, 516 aa, Homo sapiens
MLSPWPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 867280 - protein, 443 aa, Homo sapiens
PEKSSECLCPQTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 867281 - protein, 243 aa, Homo sapiens
VPIRRRLWHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 867282 - protein, 467 aa, Homo sapiens
SLECSSYSMPRIPASPLSCCPPDMLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGECRGVAP

SEQ ID NO: 867283 - protein, 558 aa, Homo sapiens; identical to SEQ ID NO: 867278

SEQ ID NO: 867284 - protein, 428 aa, Homo sapiens
RRTKLRPPYQFAAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 867285 - protein, 558 aa, Homo sapiens; identical to SEQ ID NO: 867278

SEQ ID NO: 867286 - protein, 94 aa, Homo sapiens
RGNEVISVMNRAKKAGELGPAAGSRPGHRRWSHILTSDTLGKSVGVVTTTRVQHASPAGTYAHTVNRNWYSDADVPASARQEGCQDIATQLISN

SEQ ID NO: 867287 - protein, 69 aa, Homo sapiens
LKAQLTPRLFWSCLEWALHPMTGVLIRRERQRVDRHKGEGRVKMETEIGMIQPQAKKHLRPSEVGRGKE

SEQ ID NO: 867288 - protein, 185 aa, Homo sapiens
MRRGPWASLPGRRRRWPSTPTSARAASSPRRRCLAPRGTQCTRRAPTLYPLRCTTTITTTPTCTPRRPWRRRRRTAVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 867289 - protein, 159 aa, Homo sapiens
FLGQEKGLQAWTCRLANGLDFGLLSVSSAAARSRLSFLPSFPCLPFLFYLFFLFFFFPLLLPAFFSSVGLFFIFRLCQILSHLLISFPKHPWGGAQSWLQESLGGLTFLCGSSRGWEVCRGRARVGRLPRAVGLGLVCYSADKASVMITTGWRQPCVSS

SEQ ID NO: 867290 - protein, 272 aa, Homo sapiens
MATTGALGNYYVDSFLLGADAADELSVGRYAPGTLGQPPRQAATLAEHPDFSPCSFQSKATVFGASWNPVHAAGANAVPAAVYHHHHHHPYVHPQAPVAAAAPDGRYMRSWLEPTPGALSFAGLPSSRPYGIKPEPLSARRGDCPTLDTHTLSLTDYACGSPPVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 867291 - protein, 185 aa, Homo sapiens; identical to SEQ ID NO: 867288

SEQ ID NO: 867292 - protein, 93 aa, Homo sapiens
VRLLLLNPVFLFPADNPAANWLHARSTRKKRCPYTKHQTLELEKEFLFNMYLTRDRRYEVARLLNLTERQVKIWFQNRRMKMKKINKDRAKDE

SEQ ID NO: 867293 - protein, 272 aa, Homo sapiens; identical to SEQ ID NO: 867290

SEQ ID NO: 867294 - protein, 208 aa, Homo sapiens
MATTGALGNYYVDSFLLGADAADELSVGRYAPGTLGQPPRQAATLAEHPDFSPCSFQSKATVFGASWNPVHAAGAGGLARGRVGPRGARGGRGGGAGGGGWVVGGGGVGGGGRGGGAWGGGGGERVGGGARARKGGDLVRSGCEQLNWSRDLRLVAVGVSLPGVEEKQTPRKGRRASGKEQSGVESEGAGVTKARPQSESPEYSPKAG

SEQ ID NO: 867295 - protein, 73 aa, Homo sapiens
TGGRRLPRGWAGPGQARWQGSLLGGGGSGGGGGGGGRGSPSRAAPELVGDLGSFLLLGSTFLSTARHCLHYFS

SEQ ID NO: 867296 - protein, 131 aa, Homo sapiens
RHLFKYYLDGRNLSGPYSPGAEVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 867297 - protein, 236 aa, Homo sapiens
MATTGALGNYYVDSFLLGADAADELSVGRYAPGTLGQPPRQAATLAEHPDFSPCSFQSKATVFGASWNPVHAAGANAVPAAVYHHHHHHPYVHPQAPVAAAAPDGRYMRSWLEPTPGALSFAGLPSSRPYGIKPEPLSARRGDCPTLDTHTLSLTDYACGSPPVDREKQPSEGAFSENNAENESGGDKPPIDPSKCLLPSNPPPPPRRPPGSAGPPGFSRACLRPRWKPLELGPGA

SEQ ID NO: 867298 - protein, 128 aa, Homo sapiens
MEHSEGAPGDPAGTVVPQELLEEMLWFFRVEDASPWNHSILALAAVVVIISMVLLGRSIQASRKEKMQPPEKETPEVLHLDEAKDHNSLNNLRETLLSEKPNLAQVELELKERDVLSVFLPDVPETES

SEQ ID NO: 867299 - protein, 123 aa, Homo sapiens
MEHSEGAPGDPAGTVVPQELLEEMLWFFRVEDASPWNHSILALAAVVVIISMVLLGRSIQASRKEKMQPPEKETPEVLHLDEAKDHNSLNNLRETLLSEKPNLAQVELEASEGSEKPHPKPDT

SEQ ID NO: 867300 - protein, 712 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEV

SEQ ID NO: 867301 - protein, 754 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKSDIFNIIEHTCTIEFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 867302 - protein, 616 aa, Homo sapiens
MLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 867303 - protein, 750 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 867304 - protein, 643 aa, Homo sapiens
YTHITQPKYKQQRKKDSAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 867305 - protein, 750 aa, Homo sapiens; identical to SEQ ID NO: 867303

SEQ ID NO: 867306 - protein, 750 aa, Homo sapiens; identical to SEQ ID NO: 867303

SEQ ID NO: 867307 - protein, 732 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 867308 - protein, 750 aa, Homo sapiens; identical to SEQ ID NO: 867303

SEQ ID NO: 867309 - protein, 750 aa, Homo sapiens; identical to SEQ ID NO: 867303

SEQ ID NO: 867310 - protein, 750 aa, Homo sapiens; identical to SEQ ID NO: 867303

SEQ ID NO: 867311 - protein, 149 aa, Homo sapiens
MEIMIELKAHPSISSISRCIMGFISKERERALLKDQQPGTFLLRFSESSREGAITFTWVERSQNGGGEWEFEHIVHHSMCVKSLFIAASQLIQIVRLGHEIADLILTPNEPPIGFNKPPQMFVVVVHSLEHIVEMMVLDVSQCNLQPVL

SEQ ID NO: 867312 - protein, 77 aa, Homo sapiens
SAAPGGSRLADPRPSRGDPARSGEAAPPRPRLALPDPARRVSGREVPGAGGGTRRDRVLGPCSWTPGEDGPSVLTRE

SEQ ID NO: 867313 - protein, 750 aa, Homo sapiens; identical to SEQ ID NO: 867303

SEQ ID NO: 867314 - protein, 750 aa, Homo sapiens; identical to SEQ ID NO: 867303

SEQ ID NO: 867315 - protein, 685 aa, Homo sapiens
KQRLVRPDSGSFLPPVTAGCPYSRLSLENNSAPAPPRPPPRLGPPPLAPRPTARPPPAPPPPAPPPPPPRRPTRQRPPRPVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 867316 - protein, 561 aa, Homo sapiens
TLERPPPTPRKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 867317 - protein, 308 aa, Homo sapiens
KVFVILETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 867318 - protein, 750 aa, Homo sapiens; identical to SEQ ID NO: 867303

SEQ ID NO: 867319 - protein, 750 aa, Homo sapiens; identical to SEQ ID NO: 867303

SEQ ID NO: 867320 - protein, 750 aa, Homo sapiens; identical to SEQ ID NO: 867303

SEQ ID NO: 867321 - protein, 657 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGGEWEFEHIVPPFHVCEVPLHRRQSAHTDSAFGT

SEQ ID NO: 867322 - protein, 293 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKIVFLPFSFLITDTKSRLRDGFDKVLPFYILLSMWLYLVFPLLLPQLYYHANAVFFFGGDKDFLSFVLKLKLKYLYCIKYNMHTVLSVALHTI

SEQ ID NO: 867323 - protein, 109 aa, Homo sapiens [sequence omitted]

SEQ ID NO: 867324 - protein, 131 aa, Homo sapiens
MGASLCLTQLLLLLGKGGLGQASIPLVKTPAGHQAFWTRTHTHTHTHTHTKLHSRPAAVTCHQESPQLRPPPILSYEKPLLWGRRLEKVGCGGQEGPCRAGGWVWLSRCFPEGSAGIRGSCGRERAPASWL

SEQ ID NO: 867325 - protein, 131 aa, Homo sapiens; identical to SEQ ID NO: 867324

SEQ ID NO: 867326 - protein, 449 aa, Homo sapiens
MASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 867327 - protein, 462 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 867328 - protein, 327 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKSPWAEQPRITRLMWTCLWRVRPGRYPGNKVSSS

SEQ ID NO: 867329 - protein, 462 aa, Homo sapiens; identical to SEQ ID NO: 867327

SEQ ID NO: 867330 - protein, 462 aa, Homo sapiens; identical to SEQ ID NO: 867327

SEQ ID NO: 867331 - protein, 462 aa, Homo sapiens; identical to SEQ ID NO: 867327

SEQ ID NO: 867332 - protein, 496 aa, Homo sapiens
LVREPEVDVPHDPRKPALALRLLPSPRRNCWIWQSRNDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 867333 - protein, 358 aa, Homo sapiens
NFQPKGPGCLNTEQDVKNQGPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 867334 - protein, 97 aa, Homo sapiens
NQIIESLGFNVSGMINSPVAEDWPSFSVIKLKNNGDFFIANEGRRPIYIDGRPVLCGSKWRLSNNSVVEIASLRFVFLINQDLIALIRAEAAKITPQ

SEQ ID NO: 867335 - protein, 225 aa, Homo sapiens
MASGTASRSEDEESLAGQKRASSQALGTIPKRRSSSRFIKRKKFDDELVESSLAGSEPSSSEKKKVRNWETEGMGGSARFHVSPEPLPAAKSPAEQAGERTKLPQPSSQMPPSWEHTSPYSPFLAAAPTPNPAIASCITFRVGGMEHASILGADSLFPALQSVKITPRWHCCGPRHCTSKSDFPVSSPPNFHSGVGDTASKEKTPYGQGLYRSNLVGWGWVLETD

SEQ ID NO: 867336 - protein, 73 aa, Homo sapiens
LVREPEVDVPHDHGSRLWPCGCYRRRGEIVGSGSLGMVRPRGSPLRVLRGVGDEMEFCRVPPGTTTPQVWGPA

SEQ ID NO: 867337 - protein, 405 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREIPGQSTMYLMVVALSLEGRLEVSRNRVFSLNTRGSSWQWSRPF

SEQ ID NO: 867338 - protein, 449 aa, Homo sapiens; identical to SEQ ID NO: 867326

SEQ ID NO: 867339 - protein, 462 aa, Homo sapiens; identical to SEQ ID NO: 867327

SEQ ID NO: 867340 - protein, 460 aa, Homo sapiens
KDRLVEPGVSAEGLPCFVRAEKLLDLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 867341 - protein, 276 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKWAVRHEAVGPRGIGGIQKKACLGGGEQVGQVDQTAGTWDFGPVGNRGLRRTEARPGLRVSRARLHGAVLGVFPVVVVRMDRFPRGAAALC

SEQ ID NO: 867342 - protein, 256 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVRNWETEGMGGSARFHVSPEPLPAAKSPAEQAGERTKLPQPSSQMPPSWEHTSPYSPFLAAAPTPNPAIASCITFRVGGMEHASILGADSLFPALQSVKITPRWHCCGPRHCTSKSDFPVSSPPNFHSGVGDTASKEKTPYGQGLYRSNLVGWGWVLETD

SEQ ID NO: 867343 - protein, 69 aa, Homo sapiens
MDKDSQGLLDSSLMASGTASRSEDEESLAGQKRASSQALGTIPKRRSSSSHQEEFDDLVSSWHFGRSAA

SEQ ID NO: 867344 - protein, 147 aa, Homo sapiens
SVETGYHHVTQAVLKLMSASHPPALISQSAGIVLAGATTPGLNAPLDGWPLSLAMAGSLCSSGTGGEMHSNNSDPIQLVLFRGKTYSWSSQQRQGHLVAAAAANMGRKQGAGEGRRSYFGRGCWADHPIRANGSPSLRMRNVILTSS

SEQ ID NO: 867345 - protein, 1319 aa, Homo sapiens
LPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPSSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRAARTRASVAVSSFEHAGPSLPGLSPGACSLPARVEEEAWDLDVKQISLAPETLDSSGDVSPGPRNSPSLQPPHPGSSTPTLASRGILGLSRQSHARALSDPTTPL

SEQ ID NO: 867346 - protein, 1271 aa, Homo sapiens
LPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPSSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRAPETLDSSGDVSPGPRNSPSLQPPHPGSSTPTLASRGILGLSRQSHARALSDPTTPL

SEQ ID NO: 867347 - protein, 1301 aa, Homo sapiens
LPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPSSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKLWFRRRRAREAYTLQATSPEIKLKWTSSIAQLLWRQAAHNKELRVQQMVSMGIGNKPFLDIKALGERTLSALLTGRAARTRASVAVSSFEHAGPSLPGLSPGACSLPARVEEEAWDLDVKQISLAPETLDSSGDVSPGPRNSPSLQPPHPGSSTPTLASRGILGLSRQSHARALSDPTTPL

SEQ ID NO: 867348 - protein, 1271 aa, Homo sapiens; identical to SEQ ID NO: 867346

SEQ ID NO: 867349 - protein, 1239 aa, Homo sapiens
LPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPSSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRAGTWKEAPRNTLDFFLGEWSPRDPK

SEQ ID NO: 867350 - protein, 1009 aa, Homo sapiens
MDHVEIQNKPSTGGTTLKGRDKAGAAMGEEAALASHVLASSLPPELLPFTHLTGGETEGTKACHCTENQKQKDFLSLLNQFCLDLTFASPVVTSLICHLQHSVYFFKVNLCLKHDFIAPAALHCPNVLGKPHSLWTVLHFLQRGNPLSFLKLNKALAVHPNNTALVPQTHSAPSDNFIKQLLIVWAMKPGYMLKFQFKNIELYYPYEASSPGYWHSLTGTMDSGQVVQNIFPEKQAIHPTGLEHLGHKKGFQSRCTVSKGTQGQECMNCYFLPITGLAAPEGDPVLLFNILTWSTNMLNTASNRQMLEIHFQSWMGLKIIYYNPLILFPLKETKGKKVYGNLLTFTQAISNRAEFGSGIGFLFDSPQMNTKINSIYCIPTIYQILCKGLYIYYFTEILTINFKSGLTILRRGKGGPGRLSNMLKVTQLLNRAMNLNLCLILKPLIFPLHEAALYIYLAELTTILDFTNILYKGALMPLLLTFKKRKFLHYFCHVLQGTLNLIIMGNKKHSDISFLFFLFKFGRRGRGSPTEGEGEDKNQNINPIPPTPLFWEHPNIRRVGYPVIFFKLEQAVEPGLRKEKPQNKHGTCSQSINFTPEFGKKGLYYYVYSNQYGEHKCRYPINFEANSSRLETDLGYLLPDSQGYKHLHSPLREYISGNIWGMRLEGRRYIQFTYPPGFFSPLLTCPTSLVGGKASEDSWLQYQLSLLLWGIEKEISTWQPGIFSCQAKTPDINPFPLIEVMFIYKGIDLPKKEPQNTGSIQCGGCLGSSDTCALDAIDTSIPAKMSANKCSFTNCGGPDSHHGPTDSRFRIYVESILVNTQAPPSNHSHTHTHTHTHTCTHTHACTHTQVHMHKHTHLMIPTSNTPQAHGDAQVPQANHCDTEGVINWGSEQLKPTLVVSRLLFCEIINTKSSNPFEFEFVILTLTAFSGKNNKDQFIDFVATMSLKKRLLKRKTGRKKKKRKWSTYSSDDATLISYNKNKNVQRKGEEKPTSLILSWHCSSKTGISAC

SEQ ID NO: 867351 - protein, 659 aa, Homo sapiens
TYREDALRYTLDFLVPAKHLLAKVQQEACVSGRASLFSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPSSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRAPETLDSSGDVSPGPRNSPSLQPPHPGSSTPTLASRGILGLSRQSHARALSDPTTPL

SEQ ID NO: 867352 - protein, 417 aa, Homo sapiens
THASRTRGSTHAVAHASRTRGRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPSSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRAPETLDSSGDVSPGPRNSPSLQPPHPGSSTPTLASRGILGLSRQSHARALSDPTTPL

SEQ ID NO: 867353 - protein, 1278 aa, Homo sapiens
LPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPSSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRAARTRASVAVSSFEHAGPSLPGLSPGACSLPARVEEEAWDLDVKQISLGEAPLKGWLPTARSWW

SEQ ID NO: 867354 - protein, 1278 aa, Homo sapiens; identical to SEQ ID NO: 867353

SEQ ID NO: 867355 - protein, 1216 aa, Homo sapiens
LPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPSSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRER

SEQ ID NO: 867356 - protein, 1253 aa, Homo sapiens
LPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPSSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKLWFRRRRAREAYTLQATSPEIKLKWTSSIAQLLWRQAAHNKELRVQQMVSMGIGNKPFLDIKALGERTLSALLTGRAPETLDSSGDVSPGPRNSPSLQPPHPGSSTPTLASRGILGLSRQSHARALSDPTTPL

SEQ ID NO: 867357 - protein, 180 aa, Homo sapiens [sequence omitted]

SEQ ID NO: 867358 - protein, 317 aa, Homo sapiens
MKRLSLVTTNRLSPHGNFLPLCTFPLAVDMAALFQEASSCPVCSDYLEKPMSLECGCAVCFKCINSLQKEPHGEDLLCCCCSMVSQKNKIRPSWQLERLASHIKELEPKLKKILQMNPRMRKFQVDMTLDADTANNFLLISDDLRSVRSGCITQNRQDLAERFDVSICILGSPRFTCGRHYWEVDVGTSTEWDLGVCRESVHRKGRIHLTTERGFWTVSLRDGSRLSASTVPLTFLFVDRKLQRVGIFLDMGMQNVSFFDAEGGSHVYTFRSVSAEEPLHLFFAPPSPPNGDKSVLSICPVINPGTTDAPVHPGEAK

SEQ ID NO: 867359 - protein, 1545 aa, Homo sapiens
MLEKFCNSTFWNSSFLDSPEADLPLCFEQTVLVWIPLGFLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 867360 - protein, 293 aa, Homo sapiens [sequence omitted]

SEQ ID NO: 867361 - protein, 1545 aa, Homo sapiens; identical to SEQ ID NO: 867359

SEQ ID NO: 867362 - protein, 1545 aa, Homo sapiens; identical to SEQ ID NO: 867359

SEQ ID NO: 867363 - protein, 211 aa, Homo sapiens [sequence omitted]

SEQ ID NO: 867364 - protein, 1527 aa, Homo sapiens
MLEKFCNSTFWNSSFLDSPEADLPLCFEQTVLVWIPLGFLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAQVMVLDNGKIIECGSPEELLQIPGPFYFMAKEAGIENVNSTKF

SEQ ID NO: 867365 - protein, 1385 aa, Homo sapiens
MLEKFCNSTFWNSSFLDSPEADLPLCFEQTVLVWIPLGFLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKVGGVKEGLDGRPCDQTTIGQSGEQLGPKPSSFGWRERVRALPLPWGGVGTQYQREG

SEQ ID NO: 867366 - protein, 105 aa, Homo sapiens
MSALTRLASFARVGGRLFRSGCARTAGDGGVRHAGGGVHIEPRYRQFPQLTRSQVFQSEFFSGLMWFWILWRFWHDSEEVLGHFPYPDPSQWTDEELGIPPDDED

SEQ ID NO: 867367 - protein, 105 aa, Homo sapiens; identical to SEQ ID NO: 867366

SEQ ID NO: 867368 - protein, 200 aa, Homo sapiens
GGRGCSEPRWCHCTPAWVTEQGLVSKRKKKKKKNYTPLSFRRGRTRGEPYRIRGATNKLFQKAWGSSATISYAWALLSGERFPAAEGLTANLGQERLPAPPLLEMSDSVTSREARAERRGSEVGRGEAAGDRGADGSEYVRSDSAGVFRSRWRPPFQKRLRTDCWRWWSPSVSVGLGMGASPACSGQRGSLGRSHLDWGA

SEQ ID NO: 867369 - protein, 105 aa, Homo sapiens; identical to SEQ ID NO: 867366

SEQ ID NO: 867370 - protein, 101 aa, Homo sapiens
MSALTRLASFARVGGRLFRSGCARTAGDGGVRHAGGGVHIEPRYRQFPQLTRSQVFQSEFFSGLMWFWILWRFWHDSEEVLGTFRILILPNGPKWTMDLNG

SEQ ID NO: 867371 - protein, 175 aa, Homo sapiens
GGRGCSEPRWCHCTPAWVTEQGLVSKRKKKKKKNYTPLSFRRGRTRGEPYRIRGATNKLFQKAWGSSATISYAWALLSGERFPAAEGLTANLGQERLPAPPLLEMSDSVTSREARAERRGSEVGRGEAAGDRGADGSEYVRSDSAGVFRSRWRPPFQKRLRTDCWRWWSPSVDPE

SEQ ID NO: 867372 - protein, 105 aa, Homo sapiens; identical to SEQ ID NO: 867366

SEQ ID NO: 867373 - protein, 200 aa, Homo sapiens; identical to SEQ ID NO: 867368

SEQ ID NO: 867374 - protein, 175 aa, Homo sapiens; identical to SEQ ID NO: 867371

SEQ ID NO: 867375 - protein, 105 aa, Homo sapiens; identical to SEQ ID NO: 867366

SEQ ID NO: 867376 - protein, 105 aa, Homo sapiens; identical to SEQ ID NO: 867366

SEQ ID NO: 867377 - protein, 105 aa, Homo sapiens; identical to SEQ ID NO: 867366

SEQ ID NO: 867378 - protein, 250 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGECSQGDRSPSSGKDGGRG

SEQ ID NO: 867379 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 867380 - protein, 283 aa, Homo sapiens; identical to SEQ ID NO: 867379

SEQ ID NO: 867381 - protein, 283 aa, Homo sapiens; identical to SEQ ID NO: 867379

SEQ ID NO: 867382 - protein, 283 aa, Homo sapiens; identical to SEQ ID NO: 867379

SEQ ID NO: 867383 - protein, 283 aa, Homo sapiens; identical to SEQ ID NO: 867379

SEQ ID NO: 867384 - protein, 347 aa, Homo sapiens
EIQAVGPSLAEPTGQPGHLPMPVLTPLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTNQSLEKSDRPLRSHPGAATSPASLGPVFTAWGPGSQGGSLRLSEHWALHLALPRPRPHSRRCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 867385 - protein, 282 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDATCHSHGPVRAWGLCSAVA

SEQ ID NO: 867386 - protein, 406 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPDIGSPCDLRGRGHLEAGAHLSPGRQKGEPDPEVAFESLSAEPVHAATALSPWSLMPGSAWPVLPAARQDCTCGTGLTAHLGAGPEPTGRHRAGGLAMNRRGSWSALGVHACRLGFGAHTSTCMPSSMPLPSCESTCLLGLRMWGHRWQVRLPSGGAQAQLVPHLHQYLKKWGSHPTCLCHWNGLVCTDGKPVCGVGVWVGTWGEDLPAGPCPGTDSASSASCPSGQKAGFSHQRSPPRTFLQALVPHAALPSLGVPPGLRSSMLGTSGHLVWLSQGFSLAGRPGSSPWPVDAVLARGWCPGLHVP

SEQ ID NO: 867387 - protein, 178 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPGKRPAQPAQPPLGQPGCPRTLHPLSMATVPQEGPGCPRPGPNPISMDAPCRGRLEVSLRPPSTSVSPLTLSPPGGPS

SEQ ID NO: 867388 - protein, 283 aa, Homo sapiens; identical to SEQ ID NO: 867379

SEQ ID NO: 867389 - protein, 283 aa, Homo sapiens; identical to SEQ ID NO: 867379

SEQ ID NO: 867390 - protein, 283 aa, Homo sapiens; identical to SEQ ID NO: 867379

SEQ ID NO: 867391 - protein, 283 aa, Homo sapiens; identical to SEQ ID NO: 867379

SEQ ID NO: 867392 - protein, 343 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTNRAWKSQTDLLRSHPGAATSPASLGPVFTAWGPGSQGGSLRLSEHWALHLALPRPRPHSRRCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 867393 - protein, 283 aa, Homo sapiens; identical to SEQ ID NO: 867379

SEQ ID NO: 867394 - protein, 185 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPDIGSPCDLRGRGHLEAGAHLSPGRQKGEPDPEVAFESLSAEPVHAANGSVPLEPHARLSMASAPCGQAGLHLRDRADGTPGGRA

SEQ ID NO: 867395 - protein, 356 aa, Homo sapiens
VAAETPRPRAALREPELRAASAAAREATRPGRQEPARRPRRGRRGRSRARRRRTGSRAGPGHGESGRRAAGGRPGGPRAATEPRSDMVLLKEYRVILPVSVDEYQVGQLYSVAEASKNETGGGEGVEVLVNEPYEKDGEKGQYTHKIYHLQSKVPTFVRMLAPEGALNIHEKAWNAYPYCRTVITNEYMKEDFLIKIETWHKPDLGTQENVHKLEPEAWKHVEAVYIDIADRSQVLSKDYKAEEDPAKFKSIKTGRGPLGPNWKQELVNQKDCPYMCAYKLVTVKFKWWGLQNKVENFIHKQERRLFTNFHRQLFCWLDKWVDLTMDDIRRMEEETKRQLDEMRQKDPVKGMTADD

SEQ ID NO: 867396 - protein, 318 aa, Homo sapiens
GCRRDAPPPRGAAETGAPGGVGSGARGDEARAAGAGAATAARAAGTEQSTTKTHSRVILPVSVDEYQVGQLYSVAEASKNETGGGEGVEVLVNEPYEKDGEKGQYTHKIYHLQSKVPTFVRMLAPEGALNIHEKAWNAYPYCRTVITNEYMKEDFLIKIETWHKPDLGTQENVHKLEPEAWKHVEAVYIDIADRSQVLSKDYKAEEDPAKFKSIKTGRGPLGPNWKQELVNQKDCPYMCAYKLVTVKFKWWGLQNKVENFIHKQERRLFTNFHRQLFCWLDKWVDLTMDDIRRMEEETKRQLDEMRQKDPVKGMTADD

SEQ ID NO: 867397 - protein, 184 aa, Homo sapiens
VAAETPRPRAALREPELRAASAAAREATRPGRQEPARRPRRGRRGRSRARRRRTGSRAGPGHGESGRRAAGGRPGGPRAATEPRSDMVLLKEYRVILPVSVDEYQVGQLYSVAEASKNETGGGEGVEVLVNEPYEKDGEKGQYTHKIYHLQSKVPTFVRMLAPEGALNIHEKAWNAYPYCRTGA

SEQ ID NO: 867398 - protein, 96 aa, Homo sapiens
CIQTGDLSMFNVVVALSSTHNAVTDTYQYQLICLTVCTRCSRYVAKTSRDDAQLFCWLDKWVDLTMDDIRRMEEETKRQLDEMRQKDPVKGMTADD

SEQ ID NO: 867399 - protein, 356 aa, Homo sapiens; identical to SEQ ID NO: 867395

SEQ ID NO: 867400 - protein, 356 aa, Homo sapiens; identical to SEQ ID NO: 867395

SEQ ID NO: 867401 - protein, 356 aa, Homo sapiens; identical to SEQ ID NO: 867395

SEQ ID NO: 867402 - protein, 356 aa, Homo sapiens; identical to SEQ ID NO: 867395

SEQ ID NO: 867403 - protein, 356 aa, Homo sapiens; identical to SEQ ID NO: 867395

SEQ ID NO: 867404 - protein, 323 aa, Homo sapiens
VAAETPRPRAALREPELRAASAAAREATRPGRQEPARRPRRGRRGRSRARRRRTGSRAGPGHGESGRRAAGGRPGGPRAATEPRSDMVLLKEYRVILPVSVDEYQVGQLYSVAEASKNETGGGEGVEVLVNEPYEKDGEKGQYTHKIYHLQSKVPTFVRMLAPEGALNIHEKAWNAYPYCRTVITNEYMKEDFLIKIETWHKPDLGTQENVHKLEPEAWKHVEAVYIDIADRSQVLSKDYKAEEDPAKFKSIKTGRGPLGPNWKQELVNQKDCPYMCAYKLVTVKFKWWGLQNKVENFIHKQERRHSSTTSALGLGERISKLP

SEQ ID NO: 867405 - protein, 356 aa, Homo sapiens; identical to SEQ ID NO: 867395

SEQ ID NO: 867406 - protein, 356 aa, Homo sapiens; identical to SEQ ID NO: 867395

SEQ ID NO: 867407 - protein, 112 aa, Homo sapiens
TLEDPIDDQYGEDPCAPNWKQELVNQKDCPYMCAYKLVTVKFKWWGLQNKVENFIHKQERRLFTNFHRQLFCWLDKWVDLTMDDIRRMEEETKRQLDEMRQKDPVKGMTADD

SEQ ID NO: 867408 - protein, 390 aa, Homo sapiens
VAAETPRPRAALREPELRAASAAAREATRPGRQEPARRPRRGRRGRSRARRRRTGSRAGPGHGESGRRAAGGRPGGPRAATEPRSDMVLLKEYRVILPVSVDEYQVGQLYSVAEASKNETGGGEGVEVLVNEPYEKDGEKGQYTHKIYHLQSKVPTFVRMLAPEGALNIHEKAWNAYPYCRTVITNEYMKEDFLIKIETWHKPDLGTQENVHKLEPEAWKHVEAVYIDIADRSQVLSKDYKAEEDPAKFKSIKTGRGPLGPNWKQELVNQKDCPYMCAYKLVTVKFKWWGLQNKVENFIHKQERRLFTNFHRQLFCWLDKWVAREGLSETRFDRMKERVAKRERDQMERREISKGRTSRGREAARKWPHILGRAEVNRKTPGAPSCKKTR

SEQ ID NO: 867409 - protein, 1528 aa, Homo sapiens
VRVGGVCARLAHACSLGMAGSVPSFCTGYRLSPFGTSPPPPRPDWGGRRASAHRPSPSVSLNLHLAPGLQGKAPGKPPSHLILQRALPNGNLRKSLKEPNRMSPSRKKTKTRMRRDVELHPENELLDRFLQKNLKEQNQERALKRKKKEMKKKKRDIRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867410 - protein, 67 aa, Homo sapiens
AEIEPEGQSVALKEQAKTHGGDSSLAVGNAVPPPLAKAIGLEIKLCMLAKARESASAKIKEEEAAKD

SEQ ID NO: 867411 - protein, 1617 aa, Homo sapiens
PSPSRGRPGDADAKAPPARAGSRAGLARLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867412 - protein, 1495 aa, Homo sapiens [sequence omitted]

SEQ ID NO: 867413 - protein, 1036 aa, Homo sapiens
MRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867414 - protein, 1434 aa, Homo sapiens
PSPSRGRPGDADAKAPPARAGSRAGLARLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKRSRDPPASASQVTGIRAEPSPSPRITRKSTRQTTITSHFAKGPAKRKPQEESERAKSDESIKEEDKDQDEKRRRVTSRERVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867415 - protein, 1616 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867416 - protein, 1616 aa, Homo sapiens; identical to SEQ ID NO: 867415

SEQ ID NO: 867417 - protein, 1589 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIG

SEQ ID NO: 867418 - protein, 1577 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQLK

SEQ ID NO: 867419 - protein, 576 aa, Homo sapiens
MIYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867420 - protein, 1037 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRSAEASVLPRGHRLF

SEQ ID NO: 867421 - protein, 949 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFK

SEQ ID NO: 867422 - protein, 819 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPYVHDRRQMTMTDVAILPEMRGQAKCQGRTSTRHGSHPCVDTPADGWEQRHIHNGAMTAKLDCRRADYRDTKRDSASLVNASLGFNHGYGDKLGRLQRLRRVRNTHVPENRATQHNSATQLRRPSPRP

SEQ ID NO: 867423 - protein, 586 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDETRKMRRSTEVNPKI

SEQ ID NO: 867424 - protein, 310 aa, Homo sapiens
PSPSRGRPGDADAKAPPARAGSRAGLARLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKRSRDPPASASQVTGIRAEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKCEKHRRRPETTS

SEQ ID NO: 867425 - protein, 102 aa, Homo sapiens
SIRAPTPSSKTLWWFPSSGKRVEAPQCCQTARGCAACQQWSFSPCTEASAPRKLTAQLSPGRDFDNIREGFRTVGRFFPLSVEVTPAVSPAPYSYCDYYRPR

SEQ ID NO: 867426 - protein, 1616 aa, Homo sapiens; identical to SEQ ID NO: 867415

SEQ ID NO: 867427 - protein, 1760 aa, Homo sapiens
TLEVPQFDGDSQADAVDEPQMLTNEKLSIFDANESGYESYEALPQHKLTCFSVYCKHGHLCPIDTGLIEKNIELFFSGSAKPIYDDDPSLEGGVNGKNLGPINEWWITGFDGGEKALIGFSTSFAEYILMDPRPEYAPIFGLMQEKIYISKIVVEFLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867428 - protein, 1601 aa, Homo sapiens
MVRTAEGVYDLGLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867429 - protein, 1495 aa, Homo sapiens [sequence omitted]

SEQ ID NO: 867430 - protein, 1633 aa, Homo sapiens
PSPSRGRPGDADAKAPPARAGSRAGLARLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKRSRDPPASASQVTGIRAEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867431 - protein, 1898 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEVVPLLARGKASGSKLARRSLMSGYTQGGLAAGFQLFVRSGWLADVKLFLQELYGGLSRVLQSTSCMRFKWSRSLTLLVFKKYVIREPNVFSVLVQLNVEDHEAASTSLTGVFSMSWRRCPCSWVPWARRLRPGPAHMPVRVALVMERAHESADQAHDLEIVGAWPFRVVTLKRYIHVLPGMDEVAQLDSRFCIALFPVLEGTLKLLVIGISVSARSNVSINKMDVLSFYCSKVKLLLLVAELVMAPLREKLSDYQIAFLLVCVREGTVRFSPKRLQFSPFQAAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867432 - protein, 1372 aa, Homo sapiens
MTSWQCAYRAPMGILLSHGEALVCHFPCELAMWLVFLSCYLLCICSPCRAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867433 - protein, 1616 aa, Homo sapiens; identical to SEQ ID NO: 867415

SEQ ID NO: 867434 - protein, 1616 aa, Homo sapiens; identical to SEQ ID NO: 867415

SEQ ID NO: 867435 - protein, 1557 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRCNPEADRFVKRSGVPPGVS

SEQ ID NO: 867436 - protein, 391 aa, Homo sapiens
RVGPKPKARYEAWVVARFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867437 - protein, 182 aa, Homo sapiens
MHKVLHLITKSLVDKRTSHNSFMSAKATNTMYPHASAHASGLLLVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 867438 - protein, 843 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMATSLESKLWLNHPLPSRQWRLNILYLPLPTHRARPILRIISLLRNLKHRHYPPACNYSNSLHRLCPPMRPNIILRGHSNYKLTIRHPIHWDRPSSMNLRRLLSRQSHPHTILYLSLHLALHYCSPSNTPPPILARNGIKQPPRNHLPFR

SEQ ID NO: 867439 - protein, 348 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKVKAGYLFLNSPSFFCSCLLGRECAGWGSGFKSSPIHPGSMGPSRLWEGHLFLLLGAGICGWMPVLDA

SEQ ID NO: 867440 - protein, 222 aa, Homo sapiens
PSPSRGRPGDADAKAPPARAGSRAGLARLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKNVELHPENECCSAGYRLD

SEQ ID NO: 867441 - protein, 473 aa, Homo sapiens
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 867442 - protein, 473 aa, Homo sapiens; identical to SEQ ID NO: 867441

SEQ ID NO: 867443 - protein, 372 aa, Homo sapiens
MEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 867444 - protein, 293 aa, Homo sapiens
MTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 867445 - protein, 477 aa, Homo sapiens
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNAKKKKKKKKTKKKTGKKNPPPPPMPPPPPPPTTRL

SEQ ID NO: 867446 - protein, 153 aa, Homo sapiens
MDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 867447 - protein, 332 aa, Homo sapiens
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKVLNDVYFVG

SEQ ID NO: 867448 - protein, 118 aa, Homo sapiens [sequence omitted]

SEQ ID NO: 867449 - protein, 473 aa, Homo sapiens; identical to SEQ ID NO: 867441

SEQ ID NO: 867450 - protein, 628 aa, Homo sapiens
GRLQVGCAVRGRLGNPSGRQQGARGAVESRSWAAGGAAWSSRGAQRVREGGRRGCPARVSRRCVALRRRREQRRRALLRLRLRAASAAAAAASLEPPAEAEPAPGSSSPPVPRGGCCPSPRGPGARVPSPLLPRPRGDRAAEQPPPLPAVGAPLSMSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 867451 - protein, 495 aa, Homo sapiens
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKFLSMICVKLLWAFMKWPVLYCESCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 867452 - protein, 293 aa, Homo sapiens; identical to SEQ ID NO: 867444

SEQ ID NO: 867453 - protein, 139 aa, Homo sapiens
LLHYFIQFLIFILSSLGENTLSNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 867454 - protein, 143 aa, Homo sapiens
SPTPRSEGRRESSSSLTHRPAPSPATPRLLGTRRVLLGVSEGTGCADAMELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 867455 - protein, 133 aa, Homo sapiens
SVPLAPFVPPRRLVRSGLLLGTRRVLLGVSEGTGCADAMELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 867456 - protein, 143 aa, Homo sapiens; identical to SEQ ID NO: 867454

SEQ ID NO: 867457 - protein, 91 aa, Homo sapiens
SVPLAPFVPPRRLVRSGLLLGTRRVLLGVSEGTGCAGLGLDVAVDAVVLTPGGREVKCSGGCLLKAGGRRHGVGAGLPLQPAGPHGPGQCS

SEQ ID NO: 867458 - protein, 111 aa, Homo sapiens
MKPSSCYRFIKCRKDAMELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 867459 - protein, 116 aa, Homo sapiens
RCLSPRLSPPAGWSGPACSSGLGGSSWESRRGPAVQRTSAKASETGSRKRRDSLEKKNAAVCLGLDVAVDAVVLTPGGREVKCSGGCLLKAGGRRHGVGAGLPLQPAGPHGPGQCS

SEQ ID NO: 867460 - protein, 118 aa, Homo sapiens
TRCKEAVLYGLGEHAGGNGCADAMELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 867461 - protein, 128 aa, Homo sapiens
SVPLAPFVPPRRLVRSGLLLGTRRVLLGVSEGTGCADAMELVLVFLCSLLAPMVLASAAEKEKEMDPFHYDYQTLRIGGLVFAVVLFSVGILLILSRRCKCSFNQKPRNRAPESRELKCSHQVEASGT

SEQ ID NO: 867462 - protein, 143 aa, Homo sapiens; identical to SEQ ID NO: 867454

SEQ ID NO: 867463 - protein, 143 aa, Homo sapiens; identical to SEQ ID NO: 867454

SEQ ID NO: 867464 - protein, 143 aa, Homo sapiens; identical to SEQ ID NO: 867454

SEQ ID NO: 867465 - protein, 143 aa, Homo sapiens; identical to SEQ ID NO: 867454

SEQ ID NO: 867466 - protein, 143 aa, Homo sapiens; identical to SEQ ID NO: 867454

SEQ ID NO: 867467 - protein, 143 aa, Homo sapiens; identical to SEQ ID NO: 867454

SEQ ID NO: 867468 - protein, 125 aa, Homo sapiens
FLPISTCAREAARKSGRCMAPAELVTVPDAMELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 867469 - protein, 105 aa, Homo sapiens
MRGAKVISDAMELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 867470 - protein, 114 aa, Homo sapiens
QARYEAGGYIGRGTGCADAMELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 867471 - protein, 129 aa, Homo sapiens
MTSVPLPDGFAILISCPSTRTLQSGKAQRRQPGNEMSFHFFFPKLVLSQKPFILRLRTVSNHWGGPGFNNFLSMSARLQPTWERLLLRFTPPLCLCLLSLRLRRGCHTGNFSGQVLKEGREADKDTRGS

SEQ ID NO: 867472 - protein, 143 aa, Homo sapiens; identical to SEQ ID NO: 867454

SEQ ID NO: 867473 - protein, 143 aa, Homo sapiens; identical to SEQ ID NO: 867454

SEQ ID NO: 867474 - protein, 143 aa, Homo sapiens
MELVLVFLCSLLAPMVLASAAEKEKEMDPFHYDYQTLRIGGLVFAVVLFSVGILLILSRRCKCSFNQKPRAPGDEEAQVENLITANGELSVTTCPGGKEGTERPLCGSGRDCCQVHGQPDMLPQCQESGSPGPLQHCPLTPPN

SEQ ID NO: 867475 - protein, 474 aa, Homo sapiens
SKLAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITVLKSVPFTARTAKRGSRFFCDAAHHDESNC

SEQ ID NO: 867476 - protein, 474 aa, Homo sapiens; identical to SEQ ID NO: 867475

SEQ ID NO: 867477 - protein, 106 aa, Homo sapiens [sequence omitted]

SEQ ID NO: 867478 - protein, 133 aa, Homo sapiens [sequence omitted]

SEQ ID NO: 867479 - protein, 133 aa, Homo sapiens [sequence omitted]

SEQ ID NO: 867480 - protein, 303 aa, Homo sapiens
MESALPSIFTLVIIAEFIIGNLSNGFIVLINCIDWVSKRELSSVDKLLIILAISRIGLIWEILVSWFLALHYLAIFVSGTGLRIMIFSWIVSNHFNLWLATIFSIFYLLKIASFSSPAFLYLKWRVNKVILMILLGTLVFLFLNLIQINMHIKDWLDRYERNTTWNFSMSDFETFSVSVKFTMTMFSLTPFTVAFISFLLLIFSLQKHLQKMQLNYKGHRDPRTKVHTNALKIVISFLLFYASFFLCVLISWISELYQNTVIYMLCETIGVFSPSSHSFLLILGNAKLRQAFLLVAAKVWAKR

SEQ ID NO: 867481 - protein, 158 aa, Homo sapiens
VISGRGRRGSSFTSAGRLEKPRNSSFFLPPPSLRVSVLRRALGANRGARRGDRPPSLGGARGLAATAGASAPARWVIFSRVARAGLRVSLRRYTRAEYESEAEGVMAGQAFRKFLPLFDRVLVERSAAETVTKGGIMLPEKSPRKSIASNSSRCWIGF

SEQ ID NO: 867482 - protein, 158 aa, Homo sapiens; identical to SEQ ID NO: 867481

SEQ ID NO: 867483 - protein, 158 aa, Homo sapiens; identical to SEQ ID NO: 867481

SEQ ID NO: 867484 - protein, 158 aa, Homo sapiens; identical to SEQ ID NO: 867481

SEQ ID NO: 867485 - protein, 158 aa, Homo sapiens; identical to SEQ ID NO: 867481

SEQ ID NO: 867486 - protein, 153 aa, Homo sapiens
VISGRGRRGSSFTSAGRLEKPRNSSFFLPPPSLRVSVLRRALGANRGARRGDRPPSLGGARGLAATAGASAPARWVIFSRVARAGLRVSLRRYTRAEYESEAEGVMKGGEIQPVSVKVGDKVLLPEYGGTKVVLDDKDYFLFRDGDILGKYVD

SEQ ID NO: 867487 - protein, 150 aa, Homo sapiens
VISGRGRRGSSFTSAGRLEKPRNSSFFLPPPSLRVSVLRRALGANRGARRGDRPPSLGGARGLAATAGASAPARWVIFSRVARAGLRVSLRRYTRAEYESEAEGVMAGQAFRKFLPLFDRVLVERSAAETVTKGGIMLPEKSQGWRDSTS

SEQ ID NO: 867488 - protein, 150 aa, Homo sapiens
RFSSCLMAITACCLSPFMLRMCLEKLPAHSLNVASSIVSLANVPVVGSLPLLLPPLLLPLLFKGGLSSFLSPSSFASELVRISARARAEYESEAEGVMAGQAFRKFLPLFDRVLVERSAAETVTKGGIMLPEKSPRKSIASNSSRCWIGF

SEQ ID NO: 867489 - protein, 158 aa, Homo sapiens; identical to SEQ ID NO: 867481

SEQ ID NO: 867490 - protein, 158 aa, Homo sapiens; identical to SEQ ID NO: 867481

SEQ ID NO: 867491 - protein, 158 aa, Homo sapiens; identical to SEQ ID NO: 867481

SEQ ID NO: 867492 - protein, 158 aa, Homo sapiens; identical to SEQ ID NO: 867481

SEQ ID NO: 867493 - protein, 158 aa, Homo sapiens; identical to SEQ ID NO: 867481

SEQ ID NO: 867494 - protein, 158 aa, Homo sapiens; identical to SEQ ID NO: 867481

SEQ ID NO: 867495 - protein, 158 aa, Homo sapiens; identical to SEQ ID NO: 867481

SEQ ID NO: 867496 - protein, 158 aa, Homo sapiens; identical to SEQ ID NO: 867481

SEQ ID NO: 867497 - protein, 153 aa, Homo sapiens; identical to SEQ ID NO: 867486

SEQ ID NO: 867498 - protein, 57 aa, Homo sapiens
MYSTVALPVDNVITFSFCFKTFLFLQAGQAFRKFLPLFDRVLVERSAAETVTKGGIM

SEQ ID NO: 867499 - protein, 113 aa, Homo sapiens
LGAEIRVIWWQSLLLVFRGEEEILELLLGGMWENLSFMIRCMSTQSPHSCSLSQLLLYADKHKRDTCPAHTANEVSEISVTTVSPPEKKNVMFLVLNSFSGVIVVIELYLHEL

SEQ ID NO: 867500 - protein, 535 aa, Homo sapiens
MVIKEILEGPSPEWETKAQACTPVEDMSKLTKEETHTIKLEDSYDYDDRLERRGKGGFWKIHTDERGFSLKSVLSQEYDPTEECLSKYDIYRNNFEKHSNLIVQFDTQLDNKTSVYNEGRATFNHVSYGIVHRKILPGEKPYKCNVCGKKFRKYPSLLKHQSTHAKEKSYECEECGKEFRHISSLIAHQRMHTGEKPYECHQCGKAFSQRAHLTIHQRIHTGEKPYKCDDCGKDFSQRAHLTIHQRTHTGEKPYKCLECGKTFSHSSSLINHQRVHTGEKPYICNECGKTFSQSTHLLQHQKIHTGKKPYKCNECWKVFSQSTYLIRHQRIHSGEKCYKCNECGKAFAHSSTLIQHQTTHTGEKSYICNICGKAFSQSANLTQHHRTHTGEKPYKCSVCGKAFSQSVHLTQHQRIHNGEKPFKCNICGKAYRQGANLTQHQRIHTGEKPYKCNECGKAFIYSSSLNQHQRTHTGERPYKCNECDKDFSQRTCLIQHQRIHTGEKPYACRICGKTFTQSTNLIQHQRVHTGAKHRN

SEQ ID NO: 867501 - protein, 761 aa, Homo sapiens
MLASSKRMNSSSRSQILLRWKSDKAQSGPYNVEKEILTSRFLRDTETCRQNFRNFPYPDLAGPRKALSQLRELCLKWLRPEIHSKEQILELLVLEQFLTILPGEVRTWVKSQYPESSEEAVTLVEDLTQILEEEAPQNSTLSQDTPEEDPRGKHAFQTGWLNDLVTKESMTFKDVAVDITQEDWELMRPVQKELYKTVTLQNYWNMVSLGLTVYRPTVIPILEEPWMVIKEILEGPSPEWETKAQACTPVEDMSKLTKEETHTIKLEDSYDYDDRLERRGKGGFWKIHTDERGFSLKSVLSQEYDPTEECLSKYDIYRNNFEKHSNLIVQFDTQLDNKTSVYNEGRATFNHVSYGIVHRKILPGEKPYKCNVCGKKFRKYPSLLKHQSTHAKEKSYECEECGKEFRHISSLIAHQRMHTGEKPYECHQCGKAFSQRAHLTIHQRIHTGEKPYKCDDCGKDFSQRAHLTIHQRTHTGEKPYKCLECGKTFSHSSSLINHQRVHTGEKPYICNECGKTFSQSTHLLQHQKIHTGKKPYKCNECWKVFSQSTYLIRHQRIHSGEKCYKCNECGKAFAHSSTLIQHQTTHTGEKSYICNICGKAFSQSANLTQHHRTHTGEKPYKCSVCGKAFSQSVHLTQHQRIHNGEKPFKCNICGKAYRQGANLTQHQRIHTGEKPYKCNECGKAFIYSSSLNQHQRTHTGERPYKCNECDKDFSQRTCLIQHQRIHTGEKPYACRICGKTFTQSTNLIQHQRVHTGAKHRN

SEQ ID NO: 867502 - protein, 761 aa, Homo sapiens; identical to SEQ ID NO: 867501

SEQ ID NO: 867503 - protein, 1028 aa, Homo sapiens
MRLLWKLVILLPLINSSAGDGLLSRPIFTQEPHDVIFPLDLSKSEVILNCAANGYPSPHYRWKQNGTDIDFTMSYHYRLDGGSLAINSPHTDQDIGMYQCLATNLLGTILSRKAKLQFAYIEDFETKTRSTVSVREGQGVVLLCGPPPHFGDLSYAWTFNDNPLYVQEDNRRFVSQETGNLYIAKVEPSDVGNYTCFITNKEAQRSVQGPPTPLVQRTDGVMGEYEPKIEVRFPETIQAAKDSSVKLECFALGNPVPDISWRRLDGSPLPGKVKYSKSQAILEIPNFQQEDEGFYECIASNLRGRNLAKGQLIFYAPPEWEQKIQNTHLSIYDNLLWECKASGKPNPWYTWLKNGERLNPEERIQIENGTLIITMLNVSDSGVYQCAAENKYQIIYANAELRVLASAPDFSKSPVKKKSFVQVGGDIVIGCKPNAFPRAAISWKRGTETLRQSKRIFLLEDGSLKIYNITRSDAGSYTCIATNQFGTAKNTGSLIVKERTVITVPPSKMDVTVGESIVLPCQVSHDPSIEVVFVWFFNGDVIDLKKGVAHFERIGGESVGDLMIRNIQLHHSGKYLCTVQTTLESLSAVADIIVRGPPGPPEDVQVEDISSTTSQLSWRAGPDNNSPIQIFTIQTRTPFSVGWQAVATVPEILNGKTYNATVVGLSPWVEYEFRVVAGNSIGIGEPSEPSELLRTKASVPVVAPVNIHGGGGSRSELVITWESIPEELQNGEGFGYIIMFRPVGSTTWSKEKVSSVESSRFVYRNESIIPLSPFEVKVGVYNNEGEGSLSTVTIVYSGEDEPQLAPRGTSLQSFSASEMEVSWNAIAWNRNTGRVLGYEVLYWTDDSKESMIGKIRVSGNVTTKNITGLKANTIYFASVRAYNTAGTGPSSPPVNVTTKKSPPSQPPANIAWKLTNSKLCLNWEHVKTMENESEVLGYKILYRQNRQSKTHILETNNTSAELLVPFEEDYLIEIRTVSDGGDGSSSEEIRIPKMSSLSSRGIQFLEPSTHFLSIVIVIFHCFAIQPLI

SEQ ID NO: 867504 - protein, 217 aa, Homo sapiens
MSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAELKELSSALTTPEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 867505 - protein, 254 aa, Homo sapiens
MESGRGRFAPPEGFPFSQSPFEARPRRRKEPSPRATTTSGFLSWVAGKAMSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 867506 - protein, 154 aa, Homo sapiens
MYGKQKIYFADQDQFDMVSDADLQVLDGKIVALTAKVQSLQQSCRYMEAELKELSSALTTPEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 867507 - protein, 168 aa, Homo sapiens [sequence omitted]

SEQ ID NO: 867508 - protein, 101 aa, Homo sapiens
MTEDSVLLLPRSISAPKLLFLIIYISNTLCQMMFLLPPSDSLNTHIKFIFSSPDSSWNLSGINIRVKIATVECLIFPPPRTGFFLTFSSPNGITLHPNQKL

SEQ ID NO: 867509 - protein, 108 aa, Homo sapiens
VPGVYRCHPTTTSGFLSWVAGKAMSKGRAEAAAGAAGILLRYLQEQNRPYSSQDVFGNLQREHGLGKAVVVKTLEQLAQQGKIKEKMYGKQKIYFADQVRRTCADCHP

SEQ ID NO: 867510 - protein, 240 aa, Homo sapiens
VPGVYRCHPTTTSGFLSWVAGKAMSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAELKELSSALTTPEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 867511 - protein, 246 aa, Homo sapiens
VPGVYRCHPTTTSGFLSWVAGKAMSKGRAEAAAGAAGILLRYLQEQNRPYSSQDVFGNLQREHGLGKAVVVKTLEQLAQQGKIKEKMYGKQKIYFADQSLFVWQDQFDMVSDADLQVLDGKIVALTAKVQSLQQSCRYMEAELKELSSALTTPEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 867512 - protein, 168 aa, Homo sapiens [sequence omitted]

SEQ ID NO: 867513 - protein, 865 aa, Homo sapiens
CFWQLGFGGTLKKAFGVSFIGGRGRWSRLGQPPVEAGERGAGACDPAPPTMMKTEPRGPGGPLRSASPHRSAYEAGIQALKPPDAPGPDEAPKGAHHKKYGSNVHRIKSMFLQMGTTAGPSGEAGGGAGLAEAPRASERGVRLSLPRASSLNENVDHSALLKLGTSVSERVSRFDSKPAPSAQPAPPPHPPSRLQETRKLFERSAPAAGGDKEAARRLLRQERAGLQDRKLDVVVRFNGSTEALDKLDADAVSPTVSQLSAVFEKADSRTGLHRGPGLPRAAGVPQVNSKLVSKRSRVFQPPPPPPPAPSGDAPAEKERCPAGQQPPQHRVAPARPPPKPREVRKIKPVEVEESGESEAESAPGEVIQAEVTVHAALENGSTVATAASPAPEEPKAQAAPEKEAAAVAPPERGVGNGRAPDVAPEEVDESKKEDFSEADLVDVSAYSGLGEDSAGSALEEDDEDDEEDGEPPYEPESGCVEIPGLSEEEDPAPSRKIHFSTAPIQVFSTYSNEDYDRRNEDVDPMAASAEYELEKRVERLELFPVELEKDSEGLGISIIGMGAGADMGLEKLGIFVKTVTEGGAAHRDGRIQVNDLLVEVDGTSLVGVTQSFAASVLRNTKGRVRFMIGRERPGEQSEVAQLIQQTLEQERWQREMMEQRYAQYGEDDEETGEYATDEDEELSPTFPGGEMAIEVFELAENEDALSPVDMEPEKLVHKFKELQIKHAVTEAEIQQLKRKLQSLEQEKGRWRVEKAQLEQSVEENKERMEKLEGYWGEAQSLCQAVDEHLRETQAQYQALERKYSKAKRLIKDYQQKEIEFLKKETAQRRVLEESELARKEEMDKLLDKISELEGNLQTLRNSNST

SEQ ID NO: 867514 - protein, 364 aa, Homo sapiens
CFWQLGFGGTLKKAFGVSFIGGRGRWSRLGQPPVEAGERGAGACDPAPPTMMKTEPRGPGGPLRSASPHRSAYEAGIQALKPPDAPGPDEAPKGAHHKKYGSNVHRIKSMFLQMGTTAGPSGEAGGGAGLAEAPRASERGVRLSLPRASSLNENVDHSALLKLGTSVSERVSRFDSKPAPSAQPAPPPHPPSRLQETRKLFERSAPAAGGDKEAARRLLRQERAGLQDRKLDVVVRFNGSTEALDKLDADAVSPTVSQLSAVFEKADSRTGLHRGPGLPRAAGVPQVNSKLVSKRSRVFQPPPPPPPAPSGDAPAEKERCPAGQQPPQHRVAPSSLGTGAPTPPTPPPHLPQLQGPEGSYHRPP

SEQ ID NO: 867515 - protein, 182 aa, Homo sapiens
SPAVIIYVREKPGSTSINGSSMHQCYCWSIDVLDDPVKTRVNETLQHVTCNTWTNGGSWLVMRRSAVALDASLCCIDVHQSDAAMEKLEGYWGEAQSLCQAVDEHLRETQAQYQALERKYSKAKRLIKDYQQKEIEFLKKETAQRRVLEESELARKEEMDKLLDKISELEGNLQTLRNSNST

SEQ ID NO: 867516 - protein, 822 aa, Homo sapiens
CFWQLGFGGTLKKAFGVSFIGGRGRWSRLGQPPVEAGERGAGACDPAPPTMMKTEPRGPGGPLRSASPHRSAYEAGIQALKPPDAPGPDEAPKGAHHKKYGSNVHRIKSMFLQMGTTAGPSGEAGGGAGLAEAPRASERGVRLSLPRASSLNENVDHSALLKLGTSVSERVSRFDSKPAPSAQPAPPPHPPSRLQETRKLFERSAPAAGGDKEAARRLLRQERAGLQDRKLDVVVRFNGSTEALDKLDADAVSPTVSQLSAVFEKADSRTGLHRGPGLPRAAGVPQVNSKLVSKRSRVFQPPPPPPPAPSGDAPAEKERCPAGQQPPQHRVAPARPPPKPREVRKIKPVEVEESGESEAESAPGEVIQAEVTVHAALENGSTVATAASPAPEEPKAQAAPEKEAAAVAPPERGVGNGRAPDVAPEEVDESKKEDFSEADLVDVSAYSGLGEDSAGSALEEDDEDDEEDGEPPYEPESGCVEIPGLSEEEDPAPSRKIHFSTAPIQVFSTYSNEDYDRRNEDVDPMAASAEYELEKRVERLELFPVELEKDSEGLGISIIGMGAGADMGLEKLGIFVKTVTEGGAAHRDGRIQVNDLLVEVDGTSLVGVTQSFAASVLRNTKGRVRFMIGRERPGEQSEVAQLIQQTLEQERWQREMMEQRYAQYGEDDEETGEYATDEDEELSPTFPGGEMAIEVFELAENEDALSPVDMEPEKLVHKFKELQIKHAVTEAEIQQLKRKLQSLEQEKGRWRVEKAQLEQSVEENKERMEKLEGYWGEAQSLCQAVDEHLRETQAQYQALERFGSRNGKTSKKITIADCGQLE

SEQ ID NO: 867517 - protein, 909 aa, Homo sapiens
CFWQLGFGGTLKKAFGVSFIGGRGRWSRLGQPPVEAGERGAGACDPAPPTMMKTEPRGPGGPLRSASPHRSAYEAGIQALKPPDAPGPDEAPKGAHHKKYGSNVHRIKSMFLQMGTTAGPSGEAGGGAGLAEAPRASERGVRLSLPRASSLNENVDHSALLKLGTSVSERVSRFDSKPAPSAQPAPPPHPPSRLQETRKLFERSAPAAGGDKEAARRLLRQERAGLQDRKLDVVVRFNGSTEALDKLDADAVSPTVSQLSAVFEKADSRTGLHRGPGLPRAAGVPQVNSKLVSKRSRVFQPPPPPPPAPSGDAPAEKERCPAGQQPPQHRVAPARPPPKPREVRKIKPVEVEESGESEAESAPGEVIQAEVTVHAALENGSTVATAASPAPEEPKAQAAPEKEAAAVAPPERGVGNGRAPDVAPEEVDESKKEDFSEADLVDVSAYSGLGEDSAGSALEEDDEDDEEDGEPPYEPESGCVEIPGLSEEEDPAPSRKIHFSTAPIQVFSTYSNEDYDRRNEDVDPMAASAEYELEKRVERLELFPVELEKDSEGLGISIIGMGAGADMGLEKLGIFVKTVTEGGAAHRDGRIQVNDLLVEVDGTSLVGVTQSFAASVLRNTKGRVRLRTQPSHLSSPEEGLSLERGASAGRMMHYLAEDRGSGWCRCPCRFMIGRERPGEQSEVAQLIQQTLEQERWQREMMEQRYAQYGEDDEETGEYATDEDEELSPTFPGGEMAIEVFELAENEDALSPVDMEPEKLVHKFKELQIKHAVTEAEIQQLKRKLQSLEQEKGRWRVEKAQLEQSVEENKERMEKLEGYWGEAQSLCQAVDEHLRETQAQYQALERKYSKAKRLIKDYQQKEIEFLKKETAQRRVLEESELARKEEMDKLLDKISELEGNLQTLRNSNST

SEQ ID NO: 867518 - protein, 219 aa, Homo sapiens
GCLISHEGEWVSEIRPGGGVMTEETGEYATDEDEELSPTFPGGEMAIEVFELAENEDALSPVDMEPEKLVHKFKELQIKHAVTEAEIQQLKRKLQSLEQEKGRWRVEKAQLEQSVEENKERMEKLEGYWGEAQSLCQAVDEHLRETQAQYQALERKYSKAKRLIKDYQQKEIEFLKKETAQRRVLEESELARKEEMDKLLDKISELEGNLQTLRNSNST

SEQ ID NO: 867519 - protein, 865 aa, Homo sapiens; identical to SEQ ID NO: 867513

SEQ ID NO: 867520 - protein, 128 aa, Homo sapiens
LARLGWHLFFLRQPFLVTVKINQFNGHHWLGVDCTFFVSIDHPLVAVPSSIHHCTFSRNPPLGCRSIPFQLCPGSKPKMTSGALRCHPTATGFVLWLCESVLYKPCWQTHNSAKDLFVVSIYRSKVGA

SEQ ID NO: 867521 - protein, 99 aa, Homo sapiens
SFLSDLAYKASTRKLQSSTLFWIDKLWLGSGDLAFQPSNQSFMPTTPSIPSSPHVSVHTVKRPDQPWYQGTGRVQGNADTCPRAFSVAQRDETSTSPWM

SEQ ID NO: 867522 - protein, 365 aa, Homo sapiens
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGIYLTNSMPTLERFPISFKTYFSGNYFRHIVLGVNFAGRYGALGMSRREDLMYKPPAFRTLSELVLDFEAAYGRCWHVLKKVKLGQSVSHDPHSVEQIEWKHSVLDVERLGRDDFRKELERHARDMRLKIGKGTGPPSPTKDRKKDVSSPQRAQSSPHRRNSRSERRPSGDKKTSEPKAMPDLNGYQIRV

SEQ ID NO: 867523 - protein, 195 aa, Homo sapiens
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGMFSSHTPASNPKGRSGACS

SEQ ID NO: 867524 - protein, 365 aa, Homo sapiens; identical to SEQ ID NO: 867522

SEQ ID NO: 867525 - protein, 365 aa, Homo sapiens; identical to SEQ ID NO: 867522

SEQ ID NO: 867526 - protein, 174 aa, Homo sapiens
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYPLWSRVMATFWPVWWALFPGRAGEVSAEPPHSTTPGPPFT

SEQ ID NO: 867527 - protein, 204 aa, Homo sapiens
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGMYPSSPEGEGSGLLWASASCSESEGGVG

SEQ ID NO: 867528 - protein, 365 aa, Homo sapiens; identical to SEQ ID NO: 867522

SEQ ID NO: 867529 - protein, 204 aa, Homo sapiens; identical to SEQ ID NO: 867527

SEQ ID NO: 867530 - protein, 584 aa, Homo sapiens
CARPSLYSGRGGLAFRTRAQPGGSRAGVSSLSVTMSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 867531 - protein, 65 aa, Homo sapiens
MSAAWIPALGLGVCLLLLPGPAGSEGAGEWGSWGASRRSQGLSTSGYKRDSDPAPWASALPPEEE

SEQ ID NO: 867532 - protein, 432 aa, Homo sapiens
MSAAWIPALGLGVCLLLLPGPAGSEGAGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 867533 - protein, 534 aa, Homo sapiens
MSAAWIPALGLAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 867534 - protein, 218 aa, Homo sapiens [sequence omitted]

SEQ ID NO: 867535 - protein, 493 aa, Homo sapiens
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSSLILPQKCANVTNIEIMGTTGSHTTLLATGPQTQSPVPTNNATAQRTSGEAVEGSEDTAKPSSCTSRVCSRGG

SEQ ID NO: 867536 - protein, 151 aa, Homo sapiens
NSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGKVLVLYRRREQKKRFSEFRSK

SEQ ID NO: 867537 - protein, 584 aa, Homo sapiens; identical to SEQ ID NO: 867530

SEQ ID NO: 867538 - protein, 494 aa, Homo sapiens
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAAK

SEQ ID NO: 867539 - protein, 550 aa, Homo sapiens
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 867540 - protein, 532 aa, Homo sapiens
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 867541 - protein, 550 aa, Homo sapiens; identical to SEQ ID NO: 867539

SEQ ID NO: 867542 - protein, 92 aa, Homo sapiens
SGKGYLFASFSNLGKALKHTAQKFFTVDAGVRKGIPKVVVVFIDGWPSDDIEEAGIVAREFGVNVFIVSVAKPIPEELGMVQDVTFVDKVKW

SEQ ID NO: 867543 - protein, 283 aa, Homo sapiens
MDLWPGAWMLLLLLFLLLLFLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKPGGGG

SEQ ID NO: 867544 - protein, 283 aa, Homo sapiens; identical to SEQ ID NO: 867543

SEQ ID NO: 867545 - protein, 283 aa, Homo sapiens; identical to SEQ ID NO: 867543

SEQ ID NO: 867546 - protein, 283 aa, Homo sapiens; identical to SEQ ID NO: 867543

SEQ ID NO: 867547 - protein, 283 aa, Homo sapiens; identical to SEQ ID NO: 867543

SEQ ID NO: 867548 - protein, 283 aa, Homo sapiens; identical to SEQ ID NO: 867543

SEQ ID NO: 867549 - protein, 270 aa, Homo sapiens
MDLWPGAWMLLLLLFLLLLFLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIFLPTPTHPVGPEAGPNPLPCLPSPHLFSSLESSTSEVNVDTAPLLPPLGPIHGLLPRCSLHS

SEQ ID NO: 867550 - protein, 270 aa, Homo sapiens; identical to SEQ ID NO: 867549

SEQ ID NO: 867551 - protein, 283 aa, Homo sapiens; identical to SEQ ID NO: 867543

SEQ ID NO: 867552 - protein, 313 aa, Homo sapiens
MDLWPGAWMLLLLLFLLLLFLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKQTSGAALTSAPWGVGERNEPWLEGIGGLLIYFFFC

SEQ ID NO: 867553 - protein, 283 aa, Homo sapiens; identical to SEQ ID NO: 867543

SEQ ID NO: 867554 - protein, 283 aa, Homo sapiens; identical to SEQ ID NO: 867543

SEQ ID NO: 867555 - protein, 283 aa, Homo sapiens; identical to SEQ ID NO: 867543

SEQ ID NO: 867556 - protein, 283 aa, Homo sapiens; identical to SEQ ID NO: 867543

SEQ ID NO: 867557 - protein, 283 aa, Homo sapiens; identical to SEQ ID NO: 867543

SEQ ID NO: 867558 - protein, 283 aa, Homo sapiens; identical to SEQ ID NO: 867543

SEQ ID NO: 867559 - protein, 283 aa, Homo sapiens; identical to SEQ ID NO: 867543

SEQ ID NO: 867560 - protein, 132 aa, Homo sapiens
MWIQRHSCPLLAPSMDSCLGAVSTLDPHLLLSCLWDSCLPLISSDSAYTREGNIPSPVESLPMWSSLPLYPTLASGLIHSLEQIPPTPKSMDSMDSSICEEDFSPSGWKLIPEALPGSSWELSSAPSPSLPV

SEQ ID NO: 867561 - protein, 283 aa, Homo sapiens; identical to SEQ ID NO: 867543

SEQ ID NO: 867562 - protein, 117 aa, Homo sapiens
MWSLRVAFLPTLVQYRVLSCPCHPLGKGLGAGVREDAVVVLRPGPHMCDARGDRQKLILSLSRETPCVGTCLFYDLFPCASQLAFWDLCTPQPLDDANSLVAVGHWLPACGGHLGFW

SEQ ID NO: 867563 - protein, 828 aa, Homo sapiens
MMEGLKKRTRKAFGIRKKEKDTDSTGSPDRDGIQPSPHEPPYNSKAECAREGGKKVSKKSNGAPNGFYAEIDWERYNSPELDEEGYSIRPEEPGSTKGKHFYSSSESEEEEESHKKFNIKIKPLQSKDILKNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGNDQSATEVKIEKLPSINDLDSIFGPVLSPKSVAVNAEEKWVHFSDTSPEHVTPELTPREKVVSPPATPDNPADSPAPGPLGPPGPTGPPGPPGPPRNVLSPLNLEEVQKKVAEQTFIKDDYLETISSPKDFGLGQRATPPPPPPPTYRTVVSSPGPGSGPGPGTTSGASSPARPATPLVPCRSTTPPPPPPRPPSRPKLPPGKPGVGDVSRPFSPPIHSSSPPPIAPLARAESTSSISSTNSLSAATTPTVENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 867564 - protein, 687 aa, Homo sapiens
MMEGLKKRTRKAFGIRKKEKDTDSTGSPDRDGIQGKKKTQKTQLLLTSFFWLRALSLTLSQKKSNGAPNGFYAEIDWERYNSPELDEEGYSIRPEEPGSTKGKHFYSSSESEEEEESHKKFNIKIKPLQSKDILKNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGASSPARPATPLVPCRSTTPPPPPPRPPSRPKLPPGKPGVGDVSRPFSPPIHSSSPPPIAPLARAESTSSISSTNSLSAATTPTVVSEDDVFYDKLPSFERRCETPAENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 867565 - protein, 333 aa, Homo sapiens
MTCSVTHIVSFSLPFLNPSHPASTPGHTENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 867566 - protein, 388 aa, Homo sapiens
MMEGLKKRTRKAFGIRKKEKDTDSTGSPDRDGIQGKKKTQKTQLLLTSFFWLRALSLTLSQKKSNGAPNGFYAEIDWERYNSPELDEEGYSIRPEEPGSTKGKHFYSSSESEEEEESHKKFNIKIKPLQSKDILKNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGASSPARPATPLVPCRSTTPPPPPPRPPSRPKLPPGKPGVGDVSRPFSPPIHSSSPPPIAPLARAESTSSISSTNSLSAATTPTVVSEDDVFYDKLPSFERRCETPAGMVLAK

SEQ ID NO: 867567 - protein, 161 aa, Homo sapiens
MMEGLKKRTRKAFGIRKKEKDTDSTGSPDRDGIQPSPHEPPYNSKAECAREGGKKVSKKSNGAPNGFYAEIDWERYNSPELDEEGYSIRPEEPGSTKGKHFYSSSESEEEEESHKKFNIKIKPLQSKDILKNAATVDELKASIGNIALSPSPVVSVCVCVC

SEQ ID NO: 867568 - protein, 675 aa, Homo sapiens
MMEGLKKRTRKAFGIRKKEKDTDSTGSPDRDGIQPSPHEPPYNSKAECAREGGKKVSKKSNGAPNGFYAEIDWERYNSPELDEEGYSIRPEEPGSTKGKHFYSSSESEEEEESHKKFNIKIKPLQSKDILKNAATVDELKASIGNIALSPSPVGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGASSPARPATPLVPCRSTTPPPPPPRPPSRPKLPPGKPGVGDVSRPFSPPIHSSSPPPIAPLARAESTSSISSTNSLSAATTPTVVSEDDVFYDKLPSFERRCETPAENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 867569 - protein, 379 aa, Homo sapiens
MMEGLKKRTRKAFGIRKKEKDTDSTGSPDRDGIQGKKKTQKTQLLLTSFFWLRALSLTLSQKKSNGAPNGFYAEIDWERYNSPELDEEGYSIRPEEPGSTKGKHFYSSSESEEEEESHKKFNIKIKPLQSKDILKNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGASSPARPATPLVPCRSTTPPPPPPRPPSRPKLPPGKPGVGDVSRPFSPPIHSSSPPPIAPLARAESTSSISSTNSLSAATTPTVGKNSLLSFNPFVVLTGYFL

SEQ ID NO: 867570 - protein, 132 aa, Homo sapiens
PRACTVGAHRHQREGSSSLAADGAAGLASRSPACERGARSTRRPGSEDVTPRPCARQSPGAVRPAQARRSSPAAAQAARLAPSLSFPIGKALTVVADGFCGQSLGLRRLRGYRQHPHPEGRAGPGSRDRCPR

SEQ ID NO: 867571 - protein, 413 aa, Homo sapiens
QAPPPAHEEVAAAPARSPEPVRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867572 - protein, 412 aa, Homo sapiens
YSDYPDAYTKGMSLQMIGCFRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867573 - protein, 373 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867574 - protein, 373 aa, Homo sapiens; identical to SEQ ID NO: 867573

SEQ ID NO: 867575 - protein, 373 aa, Homo sapiens; identical to SEQ ID NO: 867573

SEQ ID NO: 867576 - protein, 373 aa, Homo sapiens; identical to SEQ ID NO: 867573

SEQ ID NO: 867577 - protein, 276 aa, Homo sapiens
MKALLERVGRPTRRTVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867578 - protein, 476 aa, Homo sapiens
QAPPPAHEEVAAAPARSPEPVRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWMESHSVTQAGVQWHDLGSRQPLPAGFEQFSASASQVAGITGTCYHARIIFIFLVEMGFTILARWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867579 - protein, 185 aa, Homo sapiens
MPFGELMFESSSSCGWVHWRLFLSQREPRWPGVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867580 - protein, 368 aa, Homo sapiens
QAPPPAHEEVAAAPARSPEPVRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRQREPRWPGVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867581 - protein, 325 aa, Homo sapiens
QAPPPAHEEVAAAPARSPEPVRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLALLKHYHCWPRPKAQLCLGTAARVKKKYWEDCQLPKVGLVAQVN

SEQ ID NO: 867582 - protein, 118 aa, Homo sapiens
MAPALRQGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867583 - protein, 301 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLASETLPLLALTFITDNSLVAAAPMLPGAVTYEARGDVKFGGRGEVLTELEVVEGREASEL

SEQ ID NO: 867584 - protein, 327 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLASETLPLLALTFITDNSLVAAGPTGPVVSYYARGMELRGGDVLGLQWLPGFHWKGPVARGGALKSIGRGASRVGLGAPHSRGGLWF

SEQ ID NO: 867585 - protein, 75 aa, Homo sapiens
VNQAVVRSSELAFLSRFWKRSRAETRCTRTVSAQISVLSGGKAKCSQFCTTGMDGGMSIWDVKSLESALKDLKIK

SEQ ID NO: 867586 - protein, 185 aa, Homo sapiens; identical to SEQ ID NO: 867579

SEQ ID NO: 867587 - protein, 413 aa, Homo sapiens; identical to SEQ ID NO: 867571

SEQ ID NO: 867588 - protein, 426 aa, Homo sapiens
QAPPPAHEEVAAAPARSPEPVRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKVRLAPPGFPPCLPGQPFPPIPTPWR

SEQ ID NO: 867589 - protein, 373 aa, Homo sapiens; identical to SEQ ID NO: 867573

SEQ ID NO: 867590 - protein, 373 aa, Homo sapiens; identical to SEQ ID NO: 867573

SEQ ID NO: 867591 - protein, 373 aa, Homo sapiens; identical to SEQ ID NO: 867573

SEQ ID NO: 867592 - protein, 268 aa, Homo sapiens
QAPPPAHEEVAAAPARSPEPVRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSRRDSGL

SEQ ID NO: 867593 - protein, 367 aa, Homo sapiens
QAPPPAHEEVAAAPARSPEPVRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAVATLASETLPLLALTFITDNSLVAAGPTGPVVSYYARGMELRGGDVLGLQWLPGFHWKGPVARGGALKSIGRGASRVGLGAPHSRGGLWF

SEQ ID NO: 867594 - protein, 194 aa, Homo sapiens
LGFEHQFPKGHLGELMFESSSSCGWVHWRLFLSQREPRWPGVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867595 - protein, 288 aa, Homo sapiens
QAPPPAHEEVAAAPARSPEPVRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMATHLPDEETQPP

SEQ ID NO: 867596 - protein, 119 aa, Homo sapiens
FHSSNKLLEQRPRLLAWLSIKPPGDNIFFGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 867597 - protein, 258 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHWRLFLSQREPRWPGVSHDSTVCLADADKKMAQIWPETTTVATSPKTPGPAPL

SEQ ID NO: 867598 - protein, 248 aa, Homo sapiens
QAPPPAHEEVAAAPARSPEPVRRVDCPESAAGARERSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRSFQPTSREVEERPVTHPRWGAPQRMPPFVGGKNFGIGFPGN

SEQ ID NO: 867599 - protein, 163 aa, Homo sapiens
RVSARRNSSTFMPVKLCGDMEPKSSCRGIYPHPSQPQTAPNTGWRPHCFPSQLCPGSCQGSCDGMRSARAGWDRSGAKCSTCGHPPSPASTLGGTVPFYFILLLFFFFFETEYRSVPQAGVQWCDLGSLQPLPPGFKRFCYLSLQSSWDYRLEYSGTISAHCN

SEQ ID NO: 867600 - protein, 283 aa, Homo sapiens
PEFASGPGAAFFHSGRLQRSLTKDSAGCFSQCRSRAMLVLRSGLTKALASRTLAPQVCSSFATGPRQYDGTFYEFRTYYLKPSNMNAFMENLKKNIHLRTSYSELVGFWSVEFGGRTNKVFHIWKYDNFAHRAEVRKALANCKEWQEQSIIPNLARIDKQETEITYLIPWSKLEKPPKEGVYELAVFQMKPGGPALWGDAFERAINAHVNLGYTKVVGVFHTEYGELNRVHVLWWNESADSRAAGRHKSHEDPRVVAAVRESVNYLVSQQNMLLIPASFSPLK

SEQ ID NO: 867601 - protein, 283 aa, Homo sapiens; identical to SEQ ID NO: 867600

SEQ ID NO: 867602 - protein, 171 aa, Homo sapiens
AGVRQWSRSRFFPLGKTSEKSHKGLGWLLFSVPKPRHARSQKRPDQGACLTDARASDNFAHRAEVRKALANCKEWQEQSIIPNLARIDKQETEITYLIPWSKLEKPPKEGVYELAVFQMKPGGPALWGDAFERAINAHVNLGYTKVVGVFHTEYGELNRGSRGTCEDLLLR

SEQ ID NO: 867603 - protein, 157 aa, Homo sapiens
MNAFMENLKKNIHLRTSYSELVGFWSVEFGGRTNKVFHIWKYDNFAHRAEVRKALANCKEWQEQSIIPNLARIDKQETEITYLIPWSKLEKPPKEGVYELAVFQMKPGGPALWGDAFERAINAHVNLGYTKVVGVFHTEYGELNRGSRGTCEDLLLR

SEQ ID NO: 867604 - protein, 283 aa, Homo sapiens; identical to SEQ ID NO: 867600

SEQ ID NO: 867605 - protein, 223 aa, Homo sapiens
PEFASGPGAAFFHSGRLQRSLTKDSAGCFSQCRSRAMLVLRSGLTKALASRTLAPQVCSSFATGPRQYDGTFYEFRTYYLKPSNMNAFMENLKKFGGRTNKVFHIWKYDNFAHRAEVRKALANCKEWQEQSIIPNLARIDKQETEITYLIPWSKLEKPPKEGVYELAVFQMKPGGPALWGDAFERAINAHVNLGYTKVVGVFHTEYGELNRGSRGTCEDLLLR

SEQ ID NO: 867606 - protein, 268 aa, Homo sapiens
PEFASGPGAAFFHSGRLQRSLTKDSAGCFSQCRSRAMLVLRSGLTKALASRTLAPQVCSSFATGPRQYDGTFYEFRTYYLKPSNMNAFMENLKKNIHLRTSYSELVGFWSVEFGGRTNKVFHIWKYDNFAHRAEVRKALANCKEWQEQSIIPNLARIDKQETEITYLIPWSKLEKPPKEALWGDAFERAINAHVNLGYTKVVGVFHTEYGELNRVHVLWWNESADSRAAGRHKSHEDPRVVAAVRESVNYLVSQQNMLLIPASFSPLK

SEQ ID NO: 867607 - protein, 141 aa, Homo sapiens
MACTYVSNLGKKQRSVSFLASGLMRVSTGPELRLHHSFVLTGDVGRRICRLLVGLFTKGDTSSKRVHPFSPGPCFLLCDLARVGSSPKINVSPFYQNQTSTQRSCTVFVWQRCSLVGPFQVTVFTMYFHHSLRSISRFSSG

SEQ ID NO: 867608 - protein, 141 aa, Homo sapiens; identical to SEQ ID NO: 867607

SEQ ID NO: 867609 - protein, 141 aa, Homo sapiens; identical to SEQ ID NO: 867607

SEQ ID NO: 867610 - protein, 451 aa, Homo sapiens
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 867611 - protein, 501 aa, Homo sapiens
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 867612 - protein, 501 aa, Homo sapiens
GKPESRAPGAGRRGHGRYGGPSGAEARGAGLQGRGAAEPWGERPPCSLSLSAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 867613 - protein, 406 aa, Homo sapiens
PGSRSLELRARGGAAMAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEMLLVEFYKGSPDLVRLQEPWSQEHTYLDKLKISLASRTPKDQSLCHVLEQVCGVLKQGS

SEQ ID NO: 867614 - protein, 379 aa, Homo sapiens
GKPESRAPGAGRRGHGRYGGPSGAEARGAGLQGRGAAEPWGERPPCSLSLSAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLVCGPPCLGARGSGAQSVGSGRGSPAYQLHESWGLVCFVCYWYTVGAQ

SEQ ID NO: 867615 - protein, 142 aa, Homo sapiens
MRAQAGSSVGAGPQPEPVFCCSSLPQDFHSHLTRSEVVGYLGGRWDVNSQSGYPGPGGRGRWRTGVTGSQLPLPTVLTVLRAFPCRSRLGDAETAAAIEEEVRGYLGGGILGRVGKGHSCPGDCPVAGSVLHPSTMGSHGEG

SEQ ID NO: 867616 - protein, 173 aa, Homo sapiens
PGSRSLELRARGGAAMAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKYWATAADEGSCRDGQTSLTTLVTTTVTADGVCFHTADISTARSHANSSCSQPHRRAD

SEQ ID NO: 867617 - protein, 551 aa, Homo sapiens
GKPESRAPGAGRRGHGRYGGPSGAEARGAGLQGRGAAEPWGERPPCSLSLSAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 867618 - protein, 471 aa, Homo sapiens
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEMLLVEFYKGSPDLVRLQEPWSQEHTYLDKLKISLASRTPKDQSLCHVLEQVCGVLKQGS

SEQ ID NO: 867619 - protein, 373 aa, Homo sapiens
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEVRGYLGGGILGRVGKGHSCPGDCPVAGSVLHPSTMGSHGEG

SEQ ID NO: 867620 - protein, 766 aa, Homo sapiens
ESLEDCPLDEDEDAFQGLGEEDEEIDQFNDDTFGSGAVDDDWQEAHERLAELEEKLPVAVNEQTGNGERDEMDLLGDHEENLAERLSKMVIENELEDPAIMRAVQTRPVLQPQPGSLNSSIWDGSEVLRRIRGPLLAQEMPTVSVLEYALPQRPPQGPEDDRDLSERALPRRSTSPIIGSPPVRAVPIGTPPKQMAVPSFTQQILCPKPVHVRPPMPPRYPAPYGERMSPNQLCSVPNSSLLGHPFPPSVPPVLSPLQRAQLLGGAQLQPGRMSPSQFARVPGFVGSPLAAMNPKLLQGRVGQMLPPAPGFRAFFSAPPSATPPPQQHPPGPGPHLQNLRSQAPMFRPDTTHLHPQHRRLLHQRQQQNRSQHRNLNGAGDRGSHRSSHQDHLRKDPYANLMLQREKDWVSKIQMMQLQSTDPYLDDFYYQNYFEKLEKLSAAEEIQGDGPKKERTKLITPQVAKLEHAYKPVQFEGSLGKLTVSSVNNPRKMIDAVVTSRSEDDETKEKQVRDKRRKTLVIIEKTYSLLLDVEDYERRYLLSLEEERPALMDDRKHKICSMYDNLRGKLPGQERPSDDHFVQIMCIRKGKRMVARILPFLSTEQAADILMTTARNLPFLIKKDAQDEVLPCLLSPFSLLLYHLPSVSITSLLRQLMNLPQSAATPALSNPHLTAVLQNKFGLSLLLILLSRGEDLQSSDPATESTQNNQWTEVMFMATRELLRIPQAALAKPISIPTNLVSLFSRYVDRQKLNLLETKLQLVQGIR

SEQ ID NO: 867621 - protein, 297 aa, Homo sapiens
GRAQGGCDRPRLSRVTKAAGPRKMMMLCDISEEDDETKEKQVRDKRRKTLVIIEKTYSLLLDVEDYERRYLLSLEEERPALMDDRKHKICSMYDNLRGKLPGQERPSDDHFVQIMCIRKGKRMVARILPFLSTEQAADILMTTARNLPFLIKKDAQDEVLPCLLSPFSLLLYHLPSVSITSLLRQLMNLPQSAATPALSNPHLTAVLQNKFGLSLLLILLSRGEDLQSSDPATESTQNNQWTEVMFMATRELLRIPQAALAKPISIPTNLVSLFSRYVDRQKLNLLETKLQLVQGIR

SEQ ID NO: 867622 - protein, 766 aa, Homo sapiens; identical to SEQ ID NO: 867620

SEQ ID NO: 867623 - protein, 709 aa, Homo sapiens
ESLEDCPLDEDEDAFQGLGEEDEEIDQFNDDTFGSGAVDDDWQEAHERLAELEEKLPVAVNEQTGNGERDEMDLLGDHEENLAERLSKMVIENELEDPAIMRAVQTRPVLQPQPGSLNSSIWDGSEVLRRIRGPLLAQEMPTVSVLEYALPQRPPQGPEDDRDLSERALPRRSTSPIIGSPPVRAVPIGTPPKQMAVPSFTQQILCPKPVHVRPPMPPRYPAPYGERMSPNQLCSVPNSSLLGHPFPPSVPPVLSPLQRAQLLGGAQLQPGRMSPSQFARVPGFVGSPLAAMNPKLLQGRVGQMLPPAPGFRAFFSAPPSATPPPQQHPPGPGPHLQNLRSQAPMFRPDTTHLHPQHRRLLHQRQQQNRSQHRNLNGAGDRGSHRSSHQDHLRKDPYANLMLQREKDWVSKIQMMQLQSTDPYLDDFYYQNYFEKLEKLSAAEEIQGDGPKKERTKLITPQVAKLEHAYKPVQFEGSLGKLTVSSVNNPRKMIDAVVTSRSEDDETKEKQVRDKRRKTLVIIEKTYSLLLDVEDYERRYLLSLEEERPALMDDRKHKICSMYDNLRGKLPGQERPSDDHFVQIMCIRKGKRMVARILPFLSTEQAADILMTTARNLPFLIKKDAQDEVLPCLLSPFSLLLYHLPSVSITSLLRQLMNLPQSAATPALSNPHLTAVLQNKFGLSLLLILLSRGEDLQSSDPATESTQNNQ

SEQ ID NO: 867624 - protein, 518 aa, Homo sapiens
ESLEDCPLDEDEDAFQGLGEEDEEIDQFNDDTFGSGAVDDDWQEAHERLAELEEKLPVAVNEQTGNGERDEMDLLGDHEENLAERLSKMVIENELEDPAIMRAVQTRPVLQPQPGSLNSSIWDGSEVLRRIRGPLLAQEMPTVSVLEYALPQRPPQGPEDDRDLSERALPRRSTSPIIGSPPVRAVPIGTPPKQMAVPSFTQQILCPKPVHVRPPMPPRYPAPYGERMSPNQLCSVPNSSLLGHPFPPSVPPVLSPLQRAQLLGGAQLQPGRMSPSQFARVPGFVGSPLAAMNPKLLQGRVGQMLPPAPGFRAFFSAPPSATPPPQQHPPGPGPHLQNLRSQAPMFRPDTTHLHPQHRRLLHQRQQQNRSQHRNLNGAGDRGSHRSSHQDHLRKDPYANLMLQREKDWVSKIQMMQLQSTDPYLDDFYYQNYFEKLEKLSAAEEIQGDGPKKERTKLITPQVAKLEHAYKPVQFEGSLGKLTVSSVNNPRKMIDAVVTSRSEDDVSVNTIVCLRTSDL

SEQ ID NO: 867625 - protein, 766 aa, Homo sapiens; identical to SEQ ID NO: 867620

SEQ ID NO: 867626 - protein, 71 aa, Homo sapiens
DRFILPARLGSPACRLPIFCPQPASCSPPSSSDTIFDPLVLLPFPDATPPTPYISHQISPSQSDQKRKLLI

SEQ ID NO: 867627 - protein, 627 aa, Homo sapiens
ESLEDCPLDEDEDAFQGLGEEDEEIDQFNDDTFGSGAVDDDWQEAHERLAELEEKLPVAVNEQTGNGERDEMDLLGDHEENLAERLSKMVIENELEDPAIMRAVQTRPVLQPQPGSLNSSIWDGSEVLRRIRGPLLAQEMPTVSVLEYALPQRPPQGPEDDRDLSERALPRRSTSPIIGSPPVRAVPIGTPPKQMAVPSFTQQILCPKPVHVRPPMPPRYPAPYGERMSPNQLCSVPNSSLLGHPFPPSVPPVLSPLQRAQLLGGAQLQPGRMSPSQFARVPGFVGSPLAAMNPKLLQGRVGQMLPPAPGFRAFFSAPPSATPPPQQHPPGPGPHLQNLRSQAPMFRPDTTHLHPQHRRLLHQRQQQNRSQHRNLNGAGDRGSHRSSHQDHLRKDPYANLMLQREKDWVSKIQMMQLQSTDPYLDDFYYQNYFEKLEKLSAAEEIQGDGPKKERTKLITPQVAKLEHAYKPVQFEGSLGKLTVSSVNNPRKMIDAVVTSRSEDDETKEKQVRDKRRKTLVIIEKTYSLLLDVEDYERRYLLSLEEERPALMDDRKHKICSMYDNLRGKLPGQERPSDDHFVQIMCIRKGKRMVARILPFLSTEQAADILMTTARNLPFLIKKDAQDE

SEQ ID NO: 867628 - protein, 1581 aa, Homo sapiens
MKAQGETEESEKLSKMSSLLERLHAKFNQNRPWSETIKLVRQVMEKRVVMSSGGHQHLVSCLETLQKALKVTSLPAMTDRLESIARQNGLGSHLSASGTECYITSDMFYVEVQLDPAGQLCDVKVAHHGENPVSCPELVQQLREKNFDEFSKHLKGLVNLYNLPGDNKLKTKMYLALQSLEQDLSKMAIMYWKATNAGPLDKILHGSVGYLTPRSGGHLMNLKYYVSPSDLLDDKTASPIILHENNVSRSLGMNASVTIEGTSAVYKLPIAPLIMGSHPVDNKWTPSFSSITSANSVDLPACFFLKFPQPIPVSRAFVQKLQNCTGIPLFETQPTYAPLYELITQFELSKDPDPIPLNHNMRFYAALPGQQHCYFLNKDAPLPDGRSLQGTLVSKITFQHPGRVPLILNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGYGMTTGNNPMSGTTTSTNTFPGGPIATLFNMSMSIKDRHESVGHGEDFSKVSQNPILTSLLQITGNGGSTIGSSPTPPHHTPPPVSSMAGNTKNHPMLMNLLKDNPAQDFSTLYGSSPLERQNSSSGSPRMEICSGSNKTKKKKSSRLPPEKPKHQTEDDFQRELFSMDVDSQNPIFDVNMTADTLDTPHITPAPSQCSTPPTTYPQPVPHPQPSIQRMVRLSSSDSIGPDVTDILSDIAEEASKLPSTSDDCPAIGTPLRDSSSSGHSQSTLFDSDVFQTNNNENPYTDPADLIADAAGSPSSDSPTNHFFHDGVDFNPDLLNSQSQSGFGEEYFDESSQSGDNDDFKGFASQALNTLGVPMLGGDNGETKFKGNNQADTVDFSIISVAGKALAPADLMEHHSGSQGPLLTTGDLGKEKTQKRVKEGNGTSNSTLSGPGLDSKPGKRSRTPSNDGKSKDKPPKRKKADTEGKSPSHSSSNRPFTPPTSTGGSKSPGSAGRSQTPPGVATPPIPKITIQIPKGTVMVGKPSSHSQYTSSGSVSSSGSKSHHSHSSSSSSSASTSGKMKSSKSEGSSSSKLSSSMYSSQGSSGSSQSKNSSQSGGKPGSSPITKHGLSSGSSSTKMKPQGKPSSLMNPSLSKPNISPSHSRPPGGSDKLASPMKPVPGTPPSSKAKSPISSGSGGSHMSGTSSSSGMKSSSGLGSSGSLSQKTPPSSNSCTASSSSFSSSGSSMSSSQNQHGSSKGKSPSRNKKPSLTAVIDKLKHGVVTSGPGGEDPLDGQMGVSTNSSSHPMSSKHNMSGGEFQGKREKSDKDKSKVSTSGSSVDSSKKTSESKNVGSTGVAKIIISKHDGGSPSIKAKVTLQKPGESSGEGLRPQMASSKNYGSPLISGSTPKHERGSPSHSKSPAYTPQNLDSESESGSSIAEKSYQNSPSSDDGIRPLPEYSTEKHKKHKKEKKKVKDKDRDRDRDKDRDKKKSHSIKPESWSKSPISSDQSLSMTSNTILSADRPSRLSPDFMIGEEDDDLMDVALIGN

SEQ ID NO: 867629 - protein, 1478 aa, Homo sapiens
MKAQGETEESEKLSKMSSLLERLHAKFNQNRPWSETIKLVEKNFDEFSKHLKGLVNLYNLPGDNKLKTKMYLALQSLEQDLSKMAIMYWKATNAGPLDKILHGSVGYLTPRSGGHLMNLKYYVSPSDLLDDKTASPIILHENNVSRSLGMNASVTIEGTSAVYKLPIAPLIMGSHPVDNKWTPSFSSITSANSVDLPACFFLKFPQPIPVSRAFVQKLQNCTGIPLFETQPTYAPLYELITQFELSKDPDPIPLNHNMRFYAALPGQQHCYFLNKDAPLPDGRSLQGTLVSKITFQHPGRVPLILNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGYGMTTGNNPMSGTTTSTNTFPGGPIATLFNMSMSIKDRHESVGHGEDFSKVSQNPILTSLLQITGNGGSTIGSSPTPPHHTPPPVSSMAGNTKNHPMLMNLLKDNPAQDFSTLYGSSPLERQNSSSGSPRMEICSGSNKTKKKKSSRLPPEKPKHQTEDDFQRELFSMDVDSQNPIFDVNMTADTLDTPHITPAPSQCSTPPTTYPQPVPHPQPSIQRMVRLSSSDSIGPDVTDILSDIAEEASKLPSTSDDCPAIGTPLRDSSSSGHSQSTLFDSDVFQTNNNENPYTDPADLIADAAGSPSSDSPTNHFFHDGVDFNPDLLNSQSQSGFGEEYFDESSQSGDNDDFKGFASQALNTLGVPMLGGDNGETKFKGNNQADTVDFSIISVAGKALAPADLMEHHSGSQGPLLTTGDLGKEKTQKRVKEGNGTSNSTLSGPGLDSKPGKRSRTPSNDGKSKDKPPKRKKADTEGKSPSHSSSNRPFTPPTSTGGSKSPGSAGRSQTPPGVATPPIPKITIQIPKGTVMVGKPSSHSQYTSSGSVSSSGSKSHHSHSSSSSSSASTSGKMKSSKSEGSSSSKLSSSMYSSQGSSGSSQSKNSSQSGGKPGSSPITKHGLSSGSSSTKMKPQGKPSSLMNPSLSKPNISPSHSRPPGGSDKLASPMKPVPGTPPSSKAKSPISSGSGGSHMSGTSSSSGMKSSSGLGSSGSLSQKTPPSSNSCTASSSSFSSSGSSMSSSQNQHGSSKGKSPSRNKKPSLTAVIDKLKHGVVTSGPGGEDPLDGQMGVSTNSSSHPMSSKHNMSGGEFQGKREKSDKDKSKVSTSGSSVDSSKKTSESKNVGSTGVAKIIISKHDGGSPSIKAKVTLQKPGESSGEGLRPQMASSKNYGSPLISGSTPKHERGSPSHSKSPAYTPQNLDSESESGSSIAEKSYQNSPSSDDGIRPLPEYSTEKHKKHKKEKKKVKDKDRDRDRDKDRDKKKSHSIKPESWSKSPISSDQSLSMTSNTILSADRPSRLSPDFMIGEEDDDLMDVALIGN

SEQ ID NO: 867630 - protein, 559 aa, Homo sapiens
MKAQGETEESEKLSKMSSLLERLHAKFNQNRPWSETIKLVRQVMEKRVVMSSGGHQHLVSCLETLQKALKVTSLPAMTDRLESIARQNGLGSHLSASGTECYITSDMFYVEVQLDPAGQLCDVKVAHHGENPVSCPELVQQLREKNFDEFSKHLKGLVNLYNLPGDNKLKTKMYLALQSLEQDLSKMAIMYWKATNAGPLDKILHGSVGYLTPRSGGHLMNLKYYVSPSDLLDDKTASPIILHENNVSRSLGMNASVTIEGTSAVYKLPIAPLIMGSHPVDNKWTPSFSSITSANSVDLPACFFLKFPQPIPVSRAFVQKLQNCTGIPLFETQPTYAPLYELITQFELSKDPDPIPLNHNMRFYAALPGQQHCYFLNKDAPLPDGRSLQGTLVSKITFQHPGRVPLILNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGYAIPQGAGTELD

SEQ ID NO: 867631 - protein, 72 aa, Homo sapiens
PRVADAWVAHASATRPRVLSKILRPYFDIDTCTVPFLIIPFRICISGMGHGPQHNSSGLKKKSQVIPLCVMS

SEQ ID NO: 867632 - protein, 1563 aa, Homo sapiens
MKAQGETEESEKLSKMSSLLERLHAKFNQNRPWSETIKLVRQVMEKRVVMSSGGHQHLVSCLETLQKALKVTSLPAMTDRLESIARQNGLGSHLSASGTECYITSDMFYVEVQLDPAGQLCDVKVAHHGENPVSCPELVQQLREKNFDEFSKHLKGLVNLYNLPGDNKLKTKMYLALQSLEQDLSKMAIMYWKATNAGPLDKILHGSVGYLTPRSGGHLMNLKYYVSPSDLLDDKTASPIILHENNVSRSLGMNASVTIEGTSAVYKLPIAPLIMGSHPVDNKWTPSFSSITSANSVDLPACFFLKFPQPIPVSRAFVQKLQNCTGIPLFETQPTYAPLYELITQFELSKDPDPIPLNHNMRFYAALPGQQHCYFLNKDAPLPDGRSLQGTLVSKITFQHPGRVPLILNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGYGMTTGNNPMSGTTTSTNTFPGGPIATLFNMSMSIKDRHESVGHGEDFSKVSQNPILTSLLQITGNGGSTIGSSPTPPHHTPPPVSSMAGNTKNHPMLMNLLKDNPAQDFSTLYGSSPLERQNSSSGSPRMEICSGSNKTKKKKSSRLPPEKPKHQTEDDFQRELFSMDVDSQNPIFDVNMTADTLDTPHITPAPSQCSTPPTTYPQPVPHPQPSIQRMVRLSSSDSIGPDVTDILSDIAEEASKLPSTSDDCPAIGTPLRDSSSSGHSQSTLFDSDVFQTNNNENPYTDPADLIADAAGSPSSDSPTNHFFHDGVDFNPDLLNSQSQSGFGEEYFDESSQSGDNDDFKGFASQALNTLGVPMLGGDNGETKFKGNNQADTVDFSIISVAGKALAPADLMEHHSGSQGPLLTTGDLGKEKTQKRVKEGNGTSNSTLSGPGLDSKPGKRSRTPSNDGKSKDKPPKRKKADTEGKSPSHSSSNRPFTPPTSTGGSKSPGSAGRSQTPPGVATPPIPKITIQIPKGTVMVGKPSSHSQYTSSGSVSSSGSKSHHSHSSSSSSSASTSGKMKSSKSEGSSSSKLSSSMYSSQGSSGSSQSKNSSQSGGKPGSSPITKHGLSSGSSSTKMKPQGKPSSLMNPSLSKPNISPSHSRPPGGSDKLASPMKPVPGTPPSSKAKSPISSGSGGSHMSGTSSSSGMKSSSGLGSSGSLSQKTPPSSNSCTASSSSFSSSGSSMSSSQNQHGSSKGKSPSRNKKPSLTAVIDKLKHGVVTSGPGGEDPLDGQMGVSTNSSSHPMSSKHNMSGGEFQGKREKSDKDKSKVSTSGSSVDSSKKTSESKNVGSTGVAKIIISKHDGGSPSIKAKVTLQKPGESSGEGLRPQMASSKNYGSPLISGSTPKHERGSPSHSKSPAYTPQNLDSESESGSSIAEKSYQNSPSSDDGIRPLPEYSTEKHKKHKKEKKKVKDKDRDRDRDKDRDKNQSLSMTSNTILSADRPSRLSPDFMIGEEDDDLMDVALIGN

SEQ ID NO: 867633 - protein, 1181 aa, Homo sapiens
DRSSRYHLNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGYGMTTGNNPMSGTTTSTNTFPGGPIATLFNMSMSIKDRHESVGHGEDFSKVSQNPILTSLLQITGNGGSTIGSSPTPPHHTPPPVSSMAGNTKNHPMLMNLLKDNPAQDFSTLYGSSPLERQNSSSGSPRMEICSGSNKTKKKKSSRLPPEKPKHQTEDDFQRELFSMDVDSQNPIFDVNMTADTLDTPHITPAPSQCSTPPTTYPQPVPHPQPSIQRMVRLSSSDSIGPDVTDILSDIAEEASKLPSTSDDCPAIGTPLRDSSSSGHSQSTLFDSDVFQTNNNENPYTDPADLIADAAGSPSSDSPTNHFFHDGVDFNPDLLNSQSQSGFGEEYFDESSQSGDNDDFKGFASQALNTLGVPMLGGDNGETKFKGNNQADTVDFSIISVAGKALAPADLMEHHSGSQGPLLTTGDLGKEKTQKRVKEGNGTSNSTLSGPGLDSKPGKRSRTPSNDGKSKDKPPKRKKADTEGKSPSHSSSNRPFTPPTSTGGSKSPGSAGRSQTPPGVATPPIPKITIQIPKGTVMVGKPSSHSQYTSSGSVSSSGSKSHHSHSSSSSSSASTSGKMKSSKSEGSSSSKLSSSMYSSQGSSGSSQSKNSSQSGGKPGSSPITKHGLSSGSSSTKMKPQGKPSSLMNPSLSKPNISPSHSRPPGGSDKLASPMKPVPGTPPSSKAKSPISSGSGGSHMSGTSSSSGMKSSSGLGSSGSLSQKTPPSSNSCTASSSSFSSSGSSMSSSQNQHGSSKGKSPSRNKKPSLTAVIDKLKHGVVTSGPGGEDPLDGQMGVSTNSSSHPMSSKHNMSGGEFQGKREKSDKDKSKVSTSGSSVDSSKKTSESKNVGSTGVAKIIISKHDGGSPSIKAKVTLQKPGESSGEGLRPQMASSKNYGSPLISGSTPKHERGSPSHSKSPAYTPQNLDSESESGSSIAEKSYQNSPSSDDGIRPLPEYSTEKHKKHKKEKKKVKDKDRDRDRDKDRDKKKSHSIKPESWSKSPISSDQSLSMTSNTILSADRPSRLSPDFMIGEEDDDLMDVALIGN

SEQ ID NO: 867634 - protein, 110 aa, Homo sapiens
VAVPACLKQNKQEELSWPDSPQDIGEAAGIVFLGRFCFLGQNGSLITSVGLHAAPDTRTHAHTRVHMGHSHKPALLQGPFNLAVQGPCPSCPWGFHLAENVQGLLNLKAH

SEQ ID NO: 867635 - protein, 103 aa, Homo sapiens [sequence omitted]

SEQ ID NO: 867636 - protein, 119 aa, Homo sapiens
MKEEEGFPEDEATESEKNFKFVSLIAFTTMALLTIMEFSVYQDTWMKYEYEVDKDFSSKLRINIDITVAMKCQYVGADVLDLAETMVASADGLVYEPTVFDLSPQQEWQKMLELIQSRL

SEQ ID NO: 867637 - protein, 377 aa, Homo sapiens
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 867638 - protein, 352 aa, Homo sapiens
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 867639 - protein, 342 aa, Homo sapiens
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMSPWNWSHYSCK

SEQ ID NO: 867640 - protein, 377 aa, Homo sapiens; identical to SEQ ID NO: 867637

SEQ ID NO: 867641 - protein, 377 aa, Homo sapiens; identical to SEQ ID NO: 867637

SEQ ID NO: 867642 - protein, 294 aa, Homo sapiens
MKCHYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 867643 - protein, 345 aa, Homo sapiens
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPRAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 867644 - protein, 115 aa, Homo sapiens
EPAEFETMLLFCPGCGNGLIVEEGQRCHRFSCNTCPYVHNITRKVTNRKYPKLKEVDDVLGGAAAWENVDSTAESCPKCEHPRAYFMQLQTRSADEPMTTFYKCCNAQCGHRWRD

SEQ ID NO: 867645 - protein, 82 aa, Homo sapiens
EPAEFETMLLFCPGCGNGLIVEEGQRCHRFSCNTCPYVHNITRKVTNRKYPKLKEVDDVLGGAAAWENVDSTAGKRENCFCC

SEQ ID NO: 867646 - protein, 637 aa, Homo sapiens
MNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRTGSDFHIGHK

SEQ ID NO: 867647 - protein, 336 aa, Homo sapiens
MTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRTGSDFHIGHK

SEQ ID NO: 867648 - protein, 748 aa, Homo sapiens
SSAAVGSGGMEKLGVEPEEEGGGDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRTGSDFHIGHK

SEQ ID NO: 867649 - protein, 247 aa, Homo sapiens
SSAAVGSGGMEKLGVEPEEEGGGDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMIMWKRFEMMTDKVIRFHCKLCRVAVDD

SEQ ID NO: 867650 - protein, 705 aa, Homo sapiens
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAEPATPLKAKEATKKKKKQFGKKRKRIPPTKTRPLRQGSKKPLLEDDPQGARKISSEPVPGEIIAVRVKEEHLDVASPDKASSPELPVSVENIKQETDD

SEQ ID NO: 867651 - protein, 614 aa, Homo sapiens
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAGKLPRSL

SEQ ID NO: 867652 - protein, 666 aa, Homo sapiens
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAEPATPLKAKEATKKKKKQFGKKIIAVRVKEEHLDVASPDKASSPELPVSVENIKQETDD

SEQ ID NO: 867653 - protein, 703 aa, Homo sapiens [sequence omitted]

SEQ ID NO: 867654 - protein, 666 aa, Homo sapiens
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHGIGCCFGMKALKMTPAMTSGATWEQWMSTPLAGVAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAEPATPLKAKEATKKKKKQFGKKRKRIPPTKTRPLRQGSKKPLLEDDPQGARKISSEPVPGEIIAVRVKEEHLDVASPDKASSPELPVSVENIKQETDD

SEQ ID NO: 867655 - protein, 705 aa, Homo sapiens; identical to SEQ ID NO: 867650

SEQ ID NO: 867656 - protein, 705 aa, Homo sapiens; identical to SEQ ID NO: 867650

SEQ ID NO: 867657 - protein, 124 aa, Homo sapiens
GNKVLLCCPGWSQILALKQSSLLGLPNCRDYRQELPCLVSSHFPLTNFSTLTCSPSRPHGFPLAPLLTSVAKGGQAAALHSGRFRIYTPVPPIPPLIPLAFVGAGAHLVNAVPQVLKGPSLCLL

SEQ ID NO: 867658 - protein, 617 aa, Homo sapiens
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAGVGSRGPKRL

SEQ ID NO: 867659 - protein, 637 aa, Homo sapiens
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAELLPSSCPLCHMFVPLCTQVNYPGPSEQPW

SEQ ID NO: 867660 - protein, 690 aa, Homo sapiens [sequence omitted]

SEQ ID NO: 867661 - protein, 614 aa, Homo sapiens
MCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAEPATPLKAKEATKKKKKQFGKKRKRIPPTKTRPLRQGSKKPLLEDDPQGARKISSEPVPGEIIAVRVKEEHLDVASPDKASSPELPVSVENIKQETDD

SEQ ID NO: 867662 - protein, 705 aa, Homo sapiens; identical to SEQ ID NO: 867650

SEQ ID NO: 867663 - protein, 42 aa, Homo sapiens
PTKTRPLRQGSKKPLLEDDPQGARKISSEPVPGESKSHRAGS

SEQ ID NO: 867664 - protein, 650 aa, Homo sapiens
AGAGPGRRERLEQRAPRQLRATRSMDMGTQGSGRKRLPNRERLTAEDDALNQIAREAEARLAAKRAARAEAREIRMKELERQQKEIYQVQKKYYGLDTKWGDIEQWMEDSERYSRRSRRNTSASDEDERMSVGSRGSLRSQPDLEYGGPYAWTNGYDGELYGSQSLNRRSGRPSCLYSAARPSGSYRASVLDEGSFGGTRRGSTSGSRAPSEYSGHLNSSSRASSRASSARASPVVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEEIRQLQQKQASSIREISDLQETIEWKDKKIGALERQKEFFDSVRSERDDLREEVVMLKEELKKHGIILNSEIATNGETSDTLNNVGYQGPTKMTKEELNALKSTGDGTLDIRLKKLVDERECLLEQIKKLKGQLEERQKIGKLDNLRSEDDVLENGTDMHVMDLQRDANRQISDLKFKLAKSEQEITALEQNVIRLESQVSRYKSAAENAEKIEDELKAEKRKLQRELRSALDKTEELEVSNGHLVKRL

SEQ ID NO: 867665 - protein, 165 aa, Homo sapiens
MCCQKIMQRAIKAELHLLNVHYQMCRRHCCDIYKLVMENRNLSSNSAKKELGSALLSLLGDLKVRYVTLKEKIHKGIPLEELPPLSLESKLLSTFSTFASRLMKKETHVFSEADAEQDNQRAHDVDVSSNLKKTLSQMSLSSDNSHATQNISPKKDDFKNGDINA

SEQ ID NO: 867666 - protein, 752 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867667 - protein, 629 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDMKVLQKIMLK

SEQ ID NO: 867668 - protein, 752 aa, Homo sapiens; identical to SEQ ID NO: 867666

SEQ ID NO: 867669 - protein, 786 aa, Homo sapiens
AGAGPGRRERLEQRAPRQLRATRSMDMGTQGSGRKRLPNRERLTAEDDALNQIAREAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867670 - protein, 814 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEEIRQLQQKQASSIREISDLQETIEWKDKKIGALERQKEFFDSVRSERDDLREEVVMLKEELKKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867671 - protein, 757 aa, Homo sapiens
AGAGPGRRERLEQRAPRQLRATRSMDMGTQGSGRKRLPNRERLTAEDDALNQIAREVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867672 - protein, 828 aa, Homo sapiens
MTSPAAAQSREIDCLSPEAQKLAEARLAAKRAARAEAREIRMKELERQQKEEDSERYSRRSRRNTSASDEDERMSVGSRGSLRTNGYDGELYGSQSLNRRSGRVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867673 - protein, 653 aa, Homo sapiens
MTCFPQDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867674 - protein, 752 aa, Homo sapiens; identical to SEQ ID NO: 867666

SEQ ID NO: 867675 - protein, 752 aa, Homo sapiens; identical to SEQ ID NO: 867666

SEQ ID NO: 867676 - protein, 730 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNP

SEQ ID NO: 867677 - protein, 566 aa, Homo sapiens
MLKEELKKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867678 - protein, 567 aa, Homo sapiens
MSLFLFPEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867679 - protein, 424 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEEIRQLQQKQASSIREISDLQETIEWKDKKIGALERQKEFFDSVRSERDDLREEVVMLKEELKKHGIILNSEIATNGETSDTLNNVGYQGPTKMTKEELNALKSTGDGTLDIRLKKLVDERECLLEQIKKLKGQLEERQKIGKLDNLRSEDDVLENGTDMHVMDLQRDANRQISDLKFKLAKSEQEITALEQNVIRLESQVSRYKSAAENAEKIEDELKAEKRKLQREIIYL

SEQ ID NO: 867680 - protein, 150 aa, Homo sapiens
MTSPAAAQSREIDCLSPEAQKLAEARLAAKRAARAEAREIRMKELERQQKEIYQVQKKYYGLDTKWGDIEQWMEDSERYSRRSRRNTSASDEDERMSVGSRGSLRPSCLYSAARPSGSYRASVLDEGSFGGTRRGSTSGSRAHANHTNRW

SEQ ID NO: 867681 - protein, 177 aa, Homo sapiens
MSLFLFPEKHGIILNSEIATNGETSDTLNNVGYQGPTKMTKEELNALKSTGDGTLDIRLKKLVDERECLLEQIKKLKGQLEERQKIGKLDNLRSEDDVLENGTDMHVMDLQRDANRQISDLKFKLAKSEQEITALEQNVIRLESQVSRYKSAAENAEKIEDELKAEKRKLQREIIYL

SEQ ID NO: 867682 - protein, 209 aa, Homo sapiens
PWDGRRRPSPASPAPFHPEPDSARGHLRPAPVGRARAQRREPLPGGLAPGPGSASVHLAASGSVSADRARAPWPGPRGAPGAVPEHFPPGGAGRARQDDQPRGRSKPGDRLFEPGSAEAGKRKALPKLSFVTAAGFQGLPARSEVNGRRRCPGGVGWALAGPQRGGSGRSGRGSVSGPASGVPHALGSTLYCGTPPPRTKRHMVSPRPR

SEQ ID NO: 867683 - protein, 94 aa, Homo sapiens
DMRILEAHGHSTGPQRLLYLHHFLALSACSQLRESLLLVPASEVTCSSVQIFFFLLALLHTQALERQKEFFDSVRSERDDLREEVVMLKEELKV

SEQ ID NO: 867684 - protein, 784 aa, Homo sapiens
MTSPAAAQSREIDCLSPEAQKLAEARLAAKRAARAEAREIRMKELERQQKEEDSERYSRRSRRNTSASDEDERMSVGSRGSLRVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867685 - protein, 735 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLESREDTRGGNEKGKSKEDCTMS

SEQ ID NO: 867686 - protein, 789 aa, Homo sapiens
MTSPAAAQSREIDCLSPEAQKLAEARLAAKRAARAEAREIRMKELERQQKEIYQVQKKYYGLDTKWGDIEQWMEDSERYSRRSRRNTSVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867687 - protein, 886 aa, Homo sapiens
AGAGPGRRERLEQRAPRQLRATRSMDMGTQGSGRKRLPNRERLTAEDDALNQIAREAEARLAAKRAARAEAREIRMKELERQQKEIYQVQKKYYGLDTKWGDIEQWMEDSERYSRRSRRNTSASDEDERMSVGSRGSLRTNGYDGELYGSQSLNRRSGRPSEYSGHLNSSSRASSRASSARASPVVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867688 - protein, 776 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867689 - protein, 653 aa, Homo sapiens; identical to SEQ ID NO: 867673

SEQ ID NO: 867690 - protein, 634 aa, Homo sapiens
MVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867691 - protein, 838 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEEIRQLQQKQASSIREISDLQETIEWKDKKIGALERQKEFFDSVRSERDDLREEVVMLKEELKKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867692 - protein, 592 aa, Homo sapiens
LLQGLLDFSKLKLQYTVGVFFPFKFFVFLFVLPKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 867693 - protein, 362 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLDIRLKKLVDERECLLEQIKKLKGQLEERQKIGKLDNLRSEDDVLENGTDMHVMDLQRDANRQISDLKFKLAKSEQEITALEQNVIRLESQVSRYKSAAENAEKIEDELKAEKRKLQREIIYL

SEQ ID NO: 867694 - protein, 396 aa, Homo sapiens
AGAGPGRRERLEQRAPRQLRATRSMDMGTQGSGRKRLPNRERLTAEDDALNQIAREAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLDIRLKKLVDERECLLEQIKKLKGQLEERQKIGKLDNLRSEDDVLENGTDMHVMDLQRDANRQISDLKFKLAKSEQEITALEQNVIRLESQVSRYKSAAENAEKIEDELKAEKRKLQREIIYL

SEQ ID NO: 867695 - protein, 107 aa, Homo sapiens
MTSPAAAQSREIDCLSPEAQKLAEARLAAKRAARAEAREIRMKELERQQKEEDSERYSRRSRRNTSASDEDERMSVGSRGSLRTNGYDGELYGSQSLNRRSGRHMME

SEQ ID NO: 867696 - protein, 102 aa, Homo sapiens
YLNITKRTIPESTDRGSYPNSEGHGRPPEEVIFSRRSRMIWRQSGKIEKFALFVFESQMPSRAPVSFRSGCCLYLFLLLALPCGLLFLSLFCVCREAAGCPG

SEQ ID NO: 867697 - protein, 451 aa, Homo sapiens
MVGSALRRGAHAYVYLVSKASHISRGHQHQAWGSRPPAAECATQRAPGSVVELLGKSYPQDDHSNLTRKVLTRVGRNLHNQQHHPLWLIKERVKEHFYKQYVGRFGTPLFSVYDNLSPVVTTWQNFDSLLIPADHPSRKKGDNYYLNRTHMLRAHTSAHQWDLLHAGLDAFLVVGDVYRRDQIDSQHYPIFHQLEAVRLFSKHELFAGIKDGESLQLFEQSSRSAHKQETHTMEAVKLVEFDLKQTLTRLMAHLFGDELEIRWVDCYFPFTHPSFEMEINFHGEWLEVLGCGVMEQQLVNSAGAQDRIGWAFGLGLERLAMILYDIPDIRLFWCEDERFLKQFCVSNINQKVKFQPLSKYPAVINDISFWLPSENYAENDFYDLVRTIGGDLVEKVDLIDKFVHPKTHKTSHCYRITYRHMERTLSQREVRHIHQALQEAAVQLLGVEGRF

SEQ ID NO: 867698 - protein, 412 aa, Homo sapiens
MVGSALRRGAHAYVYLVSKASHISRGHQHQAWGSRPPAAECATQRAPGSVVELLGKSYPQDDHSNLTRKVLTRVGRNLHNQQHHPLWLIKERVKEHFYKQYVGRFGTPLFSVYDNLSPVVTTWQNFDSLLIPADHPSRKKGDNYYLNRTHMLRAHTSAHQWDLLHAGLDAFLVVGDVYRRDQIDSQHYPIFHQLEAVRLFSKHELFAGIKDGESLQLFEQSSRSAHKQETHTMEAVKLVEFDLKQTLTRLMAHLFGDELEIRWVDCYFPFTHPSFEMEINFHGEWLEVLGCGVMEQQLVNSAGAQDRIGWAFGLGLERLAMILYDIPDIRLFWCEDERFLKQFCVSNINQKVKFQPLSKYPAVINDISFWLPSENYAENDFYDLVRTIGGDLVEKVDLIDKFVHPKGKKLLK

SEQ ID NO: 867699 - protein, 305 aa, Homo sapiens
MVGSALRRGAHAYVYLVSKASHISRGHQHQAWGSRPPAAECATQRAPGSVVELLGKSYPQDDHSNLTRKVLTRVGRNLHNQQHHPLWLIKERVKEHFYKQYVGRFGTPLFSVYDNLSPVVTTWQNFDSLLIPADHPSRKKGDNYYLNRTHMLRAHTSAHQWDLLHAGLDAFLVVGDVYRRDQIDSQHYPIFHQLEAVRLFSKHELFAGIKDGESLQLFEQSSRSAHKQETHTMEAVKLVEFDLKQTLTRLMAHLFGDELEIRWVDCYFPFTHPSFEMEINFHGEWLEVLGCGVMEQQLVNSGGAT

SEQ ID NO: 867700 - protein, 83 aa, Homo sapiens
PPPSTSGSSHKSPPIFKARGHSLRLSKGGLSKPHWKIMTHKTSHCYRITYRHMERTLSQREVRHIHQALQEAAVQLLGVEGRF

SEQ ID NO: 867701 - protein, 451 aa, Homo sapiens; identical to SEQ ID NO: 867697

SEQ ID NO: 867702 - protein, 451 aa, Homo sapiens; identical to SEQ ID NO: 867697

SEQ ID NO: 867703 - protein, 131 aa, Homo sapiens
MILYDIPDIRLFWCEDERFLKQFCVSNINQKVKFQPLSKYPAVINDISFWLPSENYAENDFYDLVRTIGGDLVEKVDLIDKFVHPKTHKTSHCYRITYRHMERTLSQREVRHIHQALQEAAVQLLGVEGRF

SEQ ID NO: 867704 - protein, 70 aa, Homo sapiens
LHAGLDAFLVVGDVYRRDQIDSQHYPIFHQLEAVRLFSKHEVSLEMFLIAEGCHRHFMLRSLTFSSMRPA

SEQ ID NO: 867705 - protein, 214 aa, Homo sapiens
FTEWKFYLSGVGLFPQPLDTERITTRIGLQSTIVIPFKNPTMEDVLIDIILTSVEHPRNLVMDHCWDSFIYESSAFRFSSPSEIQGIALPPKGNIDISLLFIPQIMKLHKTMVIIEMTKANGKYWPIDNFDELDIKFKSIVGIDSEEIQAIHWIYPIVGLPQAPPPKSPPVVIQCQSRKRAEEKVEIILNAGFFGFSLTPDLTEVLVIPKKKFT

SEQ ID NO: 867706 - protein, 146 aa, Homo sapiens
QAGAGSREHGGAVEGVTGFRRLASGSAVCSLAAGLRVGRLRRLLPLQFSRCGHESGCTAVIHPHLLKMHPDLSPHLHTEECNVLINLLKECHKNHNILKFFGYCNDVDRELRKCLKNEYVENRTKSREHGIAMRKKLFNPPEESEK

SEQ ID NO: 867707 - protein, 141 aa, Homo sapiens
QAGAGSREHGGAVEGVTGFRRLASGSAVCSLAAGLRVGRLRRLLPLQFSRCGHESGCTAVIHPHLLKMHPDLSPHLHTEECNVLINLLKECHKNHNILKFFGYCNDVDRELRKCLKNEVLALSPKLECSRVIVTHGSLKLK

SEQ ID NO: 867708 - protein, 76 aa, Homo sapiens
QAGAGSREHGGAVEGVTGFRRLASGSAVCSLAAGLRVGRLRRLLPLQFSRCGHESAVAILMDMGWFLFSIWNFKKN

SEQ ID NO: 867709 - protein, 160 aa, Homo sapiens
QAGAGSREHGGAVEGVTGFRRLASGSAVCSLAAGLRVGRLRRLLPLQFSRCGHESGCTAVIHPHLLKMHPDLSPHLHTEECNVLINLLKECHKNETCIISATYSVQKKSSGVYHNILKFFGYCNDVDRELRKCLKNEVLALSPKLECSRVIVTHGSLKLK

SEQ ID NO: 867710 - protein, 112 aa, Homo sapiens
QAGAGSREHGGAVEGVTGFRRLASGSAVCSLAAGLRVGRLRRLLPLQFSRCGHESGTAIPVSTVAIPVYMPAHSAQEFQFLHILFSVCYFLFFFSSSHPNGYGLVPVFYLEL

SEQ ID NO: 867711 - protein, 127 aa, Homo sapiens
QAGAGSREHGGAVEGVTGFRRLASGSAVCSLAAGLRVGRLRRLLPLQFSRCGHESGCTAVIHPHLLKMHPDLSPHLHTEECNVLINLLKECHKNHNILKFFGYCNDVDRELRKCLKNEAVFPFLDSL

SEQ ID NO: 867712 - protein, 161 aa, Homo sapiens
QAGAGSREHGGAVEGVTGFRRLASGSAVCSLAAGLRVGRLRRLLPLQFSRCGHESGCTAVIHPHLLKMHPDLSPHLHTEECNVLINLLKECHKNHNILKFFGYCNDVDRELRKCLKNEYVENRTKSREHGIAMRKKLFNPPEESDGLIPERILSYLVSIIL

SEQ ID NO: 867713 - protein, 122 aa, Homo sapiens
QAGAGSREHGGAVEGVTGFRRLASGSAVCSLAAGLRVGRLRRLLPLQFSRCGHESGCTAVIHPHLLKMHPDLSPHLHTEECNVLINLLKECHKNYVENRTKSREHGIAMRKKLFNPPEESEK

SEQ ID NO: 867714 - protein, 118 aa, Homo sapiens
QAGAGSREHGGAVEGVTGFRRLASGSAVCSLAAGLRVGRLRRLLPLQFSRCGHESGCTAVIHPHLLKMHPDLSPHLHTEECNVLINLLKECHKNGTRTVIFSADTSDYNGIILKVSAL

SEQ ID NO: 867715 - protein, 141 aa, Homo sapiens; identical to SEQ ID NO: 867707

SEQ ID NO: 867716 - protein, 141 aa, Homo sapiens; identical to SEQ ID NO: 867707

SEQ ID NO: 867717 - protein, 75 aa, Homo sapiens
QAGAGSREHGGAVEGVTGFRRLASGSAVCSLAAGLRVGRLRRLLPLQFSRCGHESVRRKQDQEQGAWHCNAKETF

SEQ ID NO: 867718 - protein, 238 aa, Homo sapiens
MEGAPPGSLALRLLLFVALPASGWLTTGAPEPPPLSGAPQDGIRINVTTLKDDGDISKQQVVLNITYESGQVYVNDLPVNSGVTRISCQTLIVKNENLENLEEKEYFGIVSVRILVHEWPMTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSY

SEQ ID NO: 867719 - protein, 164 aa, Homo sapiens
HIEPVPAGWAQIRCQTLIVKNENLENLEEKEYFGIVSVRILVHEWPMTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSY

SEQ ID NO: 867720 - protein, 166 aa, Homo sapiens
VLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGQPVLFCLPGFRGLHLH

SEQ ID NO: 867721 - protein, 144 aa, Homo sapiens
YRCKRTVDCKSAQTNYNNEDTDIKEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAARTTTFG

SEQ ID NO: 867722 - protein, 589 aa, Homo sapiens
MRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENAAGADPDKARQEPSHGAEREEAWAQVRAHLRDRGQPRQALRHGGRSGWTEVPRCWFQQKGGEGLRCSCCPRKAFP

SEQ ID NO: 867723 - protein, 589 aa, Homo sapiens; identical to SEQ ID NO: 867722

SEQ ID NO: 867724 - protein, 589 aa, Homo sapiens; identical to SEQ ID NO: 867722

SEQ ID NO: 867725 - protein, 589 aa, Homo sapiens; identical to SEQ ID NO: 867722

SEQ ID NO: 867726 - protein, 589 aa, Homo sapiens; identical to SEQ ID NO: 867722

SEQ ID NO: 867727 - protein, 589 aa, Homo sapiens; identical to SEQ ID NO: 867722

SEQ ID NO: 867728 - protein, 438 aa, Homo sapiens
MRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKGTGRARWLTPVIPALWEAEAGESLELRSFETISLGNMAKPRLYKKYKN

SEQ ID NO: 867729 - protein, 589 aa, Homo sapiens; identical to SEQ ID NO: 867722

SEQ ID NO: 867730 - protein, 221 aa, Homo sapiens [sequence omitted]

SEQ ID NO: 867731 - protein, 589 aa, Homo sapiens; identical to SEQ ID NO: 867722

SEQ ID NO: 867732 - protein, 589 aa, Homo sapiens; identical to SEQ ID NO: 867722

SEQ ID NO: 867733 - protein, 589 aa, Homo sapiens; identical to SEQ ID NO: 867722

SEQ ID NO: 867734 - protein, 589 aa, Homo sapiens; identical to SEQ ID NO: 867722

SEQ ID NO: 867735 - protein, 589 aa, Homo sapiens; identical to SEQ ID NO: 867722

SEQ ID NO: 867736 - protein, 390 aa, Homo sapiens
MGLFWPSDNAKWFQKARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENAAGADPDKARQEPSHGAEREEAWAQVRAHLRDRGQPRQALRHGGRSGWTEVPRCWFQQKGGEGLRCSCCPRKAFP

SEQ ID NO: 867737 - protein, 386 aa, Homo sapiens
THTHTHSCTHTLLPTHSRRHTCTHTLLTYPRIHAYTQTHTHAHTHSYAHSVTHTFLNRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENAAGADPDKARQEPSHGAEREEAWAQVRAHLRDRGQPRQALRHGGRSGWTEVPRCWFQQKGGEGLRCSCCPRKAFP

SEQ ID NO: 867738 - protein, 315 aa, Homo sapiens
LQRVHRRPADGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENAAGADPDKARQEPSHGAEREEAWAQVRAHLRDRGQPRQALRHGGRSGWTEVPRCWFQQKGGEGLRCSCCPRKAFP

SEQ ID NO: 867739 - protein, 260 aa, Homo sapiens
MSRMVVLQLEATGEVQAGLSLCGCPTHCVTPQRQPWGLGLAELSWRPAIVLIQSHLAILSVEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENAAGADPDKARQEPSHGAEREEAWAQVRAHLRDRGQPRQALRHGGRSGWTEVPRCWFQQKGGEGLRCSCCPRKAFP

SEQ ID NO: 867740 - protein, 193 aa, Homo sapiens
MPLPRTQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSDFFTDCYGYHDFGSS

SEQ ID NO: 867741 - protein, 333 aa, Homo sapiens
MRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLSAFGYTSDPTMH

SEQ ID NO: 867742 - protein, 221 aa, Homo sapiens [sequence omitted]

SEQ ID NO: 867743 - protein, 224 aa, Homo sapiens
YDLEDPYYYESKSTTVVVEAEAAGTATAQAGHPTTQVTGGYGGGSGGGSSYQGKQGGYSQSNYNSPGSGQNYRGPPSSYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 867744 - protein, 78 aa, Homo sapiens
HGQGSYSYSNSYNSPGGGGGSDYNYESKFSELASRAPRPGQGPGPSSAAHGVAEARHCPDLWLRALGGGQVVLAAGGC

SEQ ID NO: 867745 - protein, 103 aa, Homo sapiens
RHAGRTLKMWCSLTIQMCYSVLDCFGIRCRLTTFTLRSHLPLALSTWEFDKTVALKVSSTFHRGLHHFPLSSSLNVLKHECGSCFSMEPFSGCGEVSLVIPWF

SEQ ID NO: 867746 - protein, 589 aa, Homo sapiens; identical to SEQ ID NO: 867722

SEQ ID NO: 867747 - protein, 589 aa, Homo sapiens; identical to SEQ ID NO: 867722

SEQ ID NO: 867748 - protein, 589 aa, Homo sapiens; identical to SEQ ID NO: 867722

SEQ ID NO: 867749 - protein, 589 aa, Homo sapiens; identical to SEQ ID NO: 867722

SEQ ID NO: 867750 - protein, 589 aa, Homo sapiens; identical to SEQ ID NO: 867722

SEQ ID NO: 867751 - protein, 295 aa, Homo sapiens [sequence omitted]

SEQ ID NO: 867752 - protein, 221 aa, Homo sapiens [sequence omitted]

SEQ ID NO: 867753 - protein, 589 aa, Homo sapiens; identical to SEQ ID NO: 867722

SEQ ID NO: 867754 - protein, 339 aa, Homo sapiens
MRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLALAILSVEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENAAGADPDKARQEPSHGAEREEAWAQVRAHLRDRGQPRQALRHGGRSGWTEVPRCWFQQKGGEGLRCSCCPRKAFP

SEQ ID NO: 867755 - protein, 589 aa, Homo sapiens; identical to SEQ ID NO: 867722

SEQ ID NO: 867756 - protein, 438 aa, Homo sapiens; identical to SEQ ID NO: 867728

SEQ ID NO: 867757 - protein, 408 aa, Homo sapiens
MRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEEEERRKEEERRKEKEE

SEQ ID NO: 867758 - protein, 257 aa, Homo sapiens
SWNWAHAMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENAAGADPDKARQEPSHGAEREEAWAQVRAHLRDRGQPRQALRHGGRSGWTEVPRCWFQQKGGEGLRCSCCPRKAFP

SEQ ID NO: 867759 - protein, 436 aa, Homo sapiens
MRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKEEDHQKRVSSWKAEGPRTTVERLTMPVSSLQRRAIYNCTRKGPTLCELRGYLFLGRRT

SEQ ID NO: 867760 - protein, 96 aa, Homo sapiens
VTERGRKNVAEPHNPGFGMGGPMHNEVPPPPNLRGRGRGGSIRGRGRGRGFGGANHGGYMNAGAGYGSYGYGGNSATAGYSDFFTDCYGYHDFGSS

SEQ ID NO: 867761 - protein, 374 aa, Homo sapiens
VNRGWGGSLKRRKKGVERLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 867762 - protein, 493 aa, Homo sapiens
MILNSLSLCYHNKLILAPMVRVGTLPMRLLALDYGADIVYCEELIDLKMIQCKRVVNEVLSTVDFVAPDDRVVFRTCEREQNRVVFQMGTSDAERALAVARLVENDVAGIDVNMGCPKQYSTKGGMGAALLSDPDKIEKILSTLVKGTRRPVTCKIRILPSLEDTLSLVKRIERTGIAAIAVHGRKREERPQHPVSCEVIKAIADTLSIPVIANGGSHDHIQQYSDIEDFRQATAASSVMVARAAMWNPSIFLKEGLRPLEEVMQKYIRYAVQYDNHYTNTKYCLCQMLREQLESPQGRLLHAAQSSREICEAFGLGAFYEETTQELDAQQARLSAKTSEQTGEPAEDTSGVIKMAVKFDRRAYPAQITPKMCLLEWCRREKLAQPVYETVQRPLDRLFSSIVTVAEQKYQSTLWDKSKKLAEQAAAIVCLRSQGLPEGRLGEESPSLHKRKREAPDQDPGGPRAQELAQPGDLCKKPFVALGSGEESPLEGW

SEQ ID NO: 867763 - protein, 475 aa, Homo sapiens
MVRVGTLPMRLLALDYGADIVYCEELIDLKMIQCKRVVNEVLSTVDFVAPDDRVVFRTCEREQNRVVFQMGTSDAERALAVARLVENDVAGIDVNMGCPKQYSTKGGMGAALLSDPDKIEKILSTLVKGTRRPVTCKIRILPSLEDTLSLVKRIERTGIAAIAVHGRKREERPQHPVSCEVIKAIADTLSIPVIANGGSHDHIQQYSDIEDFRQATAASSVMVARAAMWNPSIFLKEGLRPLEEVMQKYIRYAVQYDNHYTNTKYCLCQMLREQLESPQGRLLHAAQSSREICEAFGLGAFYEETTQELDAQQARLSAKTSEQTGEPAEDTSGVIKMAVKFDRRAYPAQITPKMCLLEWCRREKLAQPVYETVQRPLDRLFSSIVTVAEQKYQSTLWDKSKKLAEQAAAIVCLRSQGLPEGRLGEESPSLHKRKREAPDQDPGGPRAQELAQPGDLCKKPFVALGSGEESPLEGW

SEQ ID NO: 867764 - protein, 475 aa, Homo sapiens; identical to SEQ ID NO: 867763

SEQ ID NO: 867765 - protein, 475 aa, Homo sapiens; identical to SEQ ID NO: 867763

SEQ ID NO: 867766 - protein, 190 aa, Homo sapiens
MVRVGTLPMRLLALDYGADIVYCEELIDLKMIQCKRVVNEVLSTVDFVAPDDRVVFRTCEREQNRVVFQMGTSDAERALAVARLVENDVAGIDVNMGCPKQYSTKGGMGAALLSDPDKIEKILSTLVKGTRRPVTCKIRILPSLEDTLSLVKRIERTGIAAIAVHGRSGRRTKNPDRWEVSKHGEHTILN

SEQ ID NO: 867767 - protein, 475 aa, Homo sapiens; identical to SEQ ID NO: 867763

SEQ ID NO: 867768 - protein, 406 aa, Homo sapiens
MGTSDAERALAVARLVENDVAGIDVNMGCPKQYSTKGGMGAALLSDPDKIEKILSTLVKGTRRPVTCKIRILPSLEDTLSLVKRIERTGIAAIAVHGRKREERPQHPVSCEVIKAIADTLSIPVIANGGSHDHIQQYSDIEDFRQATAASSVMVARAAMWNPSIFLKEGLRPLEEVMQKYIRYAVQYDNHYTNTKYCLCQMLREQLESPQGRLLHAAQSSREICEAFGLGAFYEETTQELDAQQARLSAKTSEQTGEPAEDTSGVIKMAVKFDRRAYPAQITPKMCLLEWCRREKLAQPVYETVQRPLDRLFSSIVTVAEQKYQSTLWDKSKKLAEQAAAIVCLRSQGLPEGRLGEESPSLHKRKREAPDQDPGGPRAQELAQPGDLCKKPFVALGSGEESPLEGW

SEQ ID NO: 867769 - protein, 355 aa, Homo sapiens
MVARPGLCGASRSLGRQRAGARLEPAPGTASGAWTARPGSRPAMEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 867770 - protein, 362 aa, Homo sapiens
RAAVQGGSAARRPERGASRSLGRQRAGARLEPAPGTASGAWTARPGSRPAMEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 867771 - protein, 355 aa, Homo sapiens; identical to SEQ ID NO: 867769

SEQ ID NO: 867772 - protein, 299 aa, Homo sapiens
RAAVQGGSAARRPERGASRSLGRQRAGARLEPAPGTASGAWTARPGSRFCHQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 867773 - protein, 180 aa, Homo sapiens
RSGAGRKRCQASGAGASRSLGRQRAGARLEPAPGTASGAWTARPGSRPAMEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALVVRTQSQASQISWFWNTGCTQAILSPKCC

SEQ ID NO: 867774 - protein, 504 aa, Homo sapiens
MVARPGLCGASRSLGRQRAGARLEPAPGTASGAWTARPGSRPAMEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGVSGVGGVLVVTEGKLRHRATKLMLGHPEHQGRAGNKHSCVLNSTPCSLSASHLTQGPCWLLTDSLGVWLARFSRTEHHPGPVLTSGDLNTIFCPKYCHPHSWQGTGRVPPQEAASRLQRGHDGRWVLVREIGVDRPRSQLIRHRPHPAGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 867775 - protein, 194 aa, Homo sapiens
RAAGRVGRPRVRCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 867776 - protein, 355 aa, Homo sapiens; identical to SEQ ID NO: 867769

SEQ ID NO: 867777 - protein, 322 aa, Homo sapiens
MVARPGLCGASRSLGRQRAGARLEPAPGTASGAWTARPGSSKAWRETLTLQKQLRYRFPELADPDTCYGFRFCHQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 867778 - protein, 381 aa, Homo sapiens
MVARPGLCGASRSLGRQRAGARLEPAPGTASGAWTARPGSRPAMEPGSVENLSIVYRSRDFLVVNKHWDVRIDSKAWRETLTLQKQLRYRFPELADPDTCYGFRKGGRPEPHGGVCGGKWLRLWTLSHSRFCHQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 867779 - protein, 324 aa, Homo sapiens
GQYYAVYGSEAWVVGASRSLGRQRAGARLEPAPGTASGAWTARPGSRPAMEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGRTHQLRVHCSALGHPVVGDLTYGEVSGREDRPFRMMLHAFYLRIQAAPPHSCLGPAGLLHPQPSPLRLRHSGAPACSGCRSGRWNRTAESRGAGAGGVSCTAGL

SEQ ID NO: 867780 - protein, 253 aa, Homo sapiens
TDPRRDDPAAAMALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKD

SEQ ID NO: 867781 - protein, 255 aa, Homo sapiens
WKRRKSKNEDVRKESALKGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKD

SEQ ID NO: 867782 - protein, 365 aa, Homo sapiens
RVAARGASQPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKEFAICKKQSFCFGFFDLNLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 867783 - protein, 117 aa, Homo sapiens
PTQFSDPSPNKLGGVLALLLSILILAIIAGHRYLVTGDYDKDNDGRLDPQELLPWVVPNNQGIAQEEALHLIDEMDLNGDKKLSEEEILENPDLFLTSEATDYGRQLHDDYFYHDEL

SEQ ID NO: 867784 - protein, 110 aa, Homo sapiens
MVTKSSLKKRFWKTRTCFSPVKPQIMADSSMMTISIMMSFNLRACLSRVLAPFIICYQLYFCDKILMLYFTLLSLNHSQNYLNVDYNFGLLGKKNKNLIFISKRIEATKY

SEQ ID NO: 867785 - protein, 110 aa, Homo sapiens; identical to SEQ ID NO: 867784

SEQ ID NO: 867786 - protein, 347 aa, Homo sapiens
RVAARGASQPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 867787 - protein, 342 aa, Homo sapiens
RVAARGASQPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWKKTLKQKKQKTKKKFIKKRKKRRKCERKKNKRKNKKKKKKKKQEKTKKTIKKQKKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 867788 - protein, 347 aa, Homo sapiens; identical to SEQ ID NO: 867786

SEQ ID NO: 867789 - protein, 110 aa, Homo sapiens; identical to SEQ ID NO: 867784

SEQ ID NO: 867790 - protein, 128 aa, Homo sapiens [sequence omitted]

SEQ ID NO: 867791 - protein, 85 aa, Homo sapiens
EVLKCQQGVSSLAFALAFLQRMDMKPLVVLGLPAPTAPSGCLSFWEAKAQLAKSCKVLVDALRHNAAAAVPFFGGGSVLRAAEPA

SEQ ID NO: 867792 - protein, 108 aa, Homo sapiens
SLQTPVATASWRPCQQTWPRNTEDQQRGDYFGILKEARVTVFPFNILDNPMYWGSTANYLGWAIMHASPTGLLLTVLVALTYIMALLYEEPFTAEIYRQKASGSHKRS

SEQ ID NO: 867793 - protein, 199 aa, Homo sapiens [sequence omitted]

SEQ ID NO: 867794 - protein, 185 aa, Homo sapiens
CAPAHIGIAWSLPGLPLGLLRGEAPVCSGVAGTARLRSCILASECGCRSGIFLNLDFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIMALLYEEPFTAEIYRQKASGSHKRS

SEQ ID NO: 867795 - protein, 138 aa, Homo sapiens
THASADAWAFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIMALLYEEPFTAEIYRQKASGSHKRS

SEQ ID NO: 867796 - protein, 117 aa, Homo sapiens
MLVRAWCGIGRGALLGLGVVLVLSSFFALGFAGTFLGDYFGILKEARVTVFPFNILDNPMYWGSTANYLGWAIMHASPTGLLLTVLVALTYIMALLYEEPFTAEIYRQKASGSHKRS

SEQ ID NO: 867797 - protein, 236 aa, Homo sapiens [sequence omitted]

SEQ ID NO: 867798 - protein, 236 aa, Homo sapiens [sequence omitted]

SEQ ID NO: 867799 - protein, 200 aa, Homo sapiens
MLKGNTVTLAPLDPSFVAAVITITFNPLYWNVVARWEHKTRKLSRAFGSPYLACYSLSITILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIMALLYEEPFTAEIYRQKASGSHKRS

SEQ ID NO: 867800 - protein, 186 aa, Homo sapiens
MIECEKSATGGRDPRTVECAQMGRFYRKLSRAFGSPYLACYSLSITILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIMALLYEEPFTAEIYRQKASGSHKRS

SEQ ID NO: 867801 - protein, 131 aa, Homo sapiens
MCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIMALLYEEPFTAEIYRQKASGSHKRS

SEQ ID NO: 867802 - protein, 196 aa, Homo sapiens
MTRLLGYVDPLDPSFVAAVITITFNPLYWNVVARWEHKTRKLSRAFGSPYLACYSLSITILLLNFLRSHCFTQAMLSQPRMESLDTPAAYSLGLALLGLGVVLVLSSFFALGFAGTFLGDYFGILKEARVTVFPFNILDNPMYWGSTANYLGWAIISPAPAGAVGSEARQPHGPAPDGAGGPHLHNGSPIRRALHR

SEQ ID NO: 867803 - protein, 97 aa, Homo sapiens
DKWIRTENMGTLVLAQKPDSGRGSAAWARSAQVAQRRPEGQGHGRKGQPGQVGRGPERPWLQPGLTCLCPFRHASPTGLLLTVLVALTYIMALLYEE

SEQ ID NO: 867804 - protein, 199 aa, Homo sapiens [sequence omitted]

SEQ ID NO: 867805 - protein, 125 aa, Homo sapiens
MLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIMALLYEEPFTAEIYRQKASGSHKRS

SEQ ID NO: 867806 - protein, 67 aa, Homo sapiens
VWRGQELVTSKEPLAMLHPALGLLHASPTGLLLTVLVALTYIMALLYEEPFTAEIYRQKASGSHKRS

SEQ ID NO: 867807 - protein, 161 aa, Homo sapiens
PVITPRRVRVPPRPLLVARWEHKTRKLSRAFGSPYLACYSLSITILLLNFLRSHCFTQAMLSQPRMESLDTPAAYSLGLALLGLGVVLVLSSFFALGFAGTFLGDYFGILKEARVTVFPFNILDNPMYWGSTANYLGWAIITPAPRGLLLTVDLSGEGVFG

SEQ ID NO: 867808 - protein, 199 aa, Homo sapiens [sequence omitted]

SEQ ID NO: 867809 - protein, 233 aa, Homo sapiens
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSITILLLNFLRSHCFTQAMLSQPRMESLDTPAAYSLGLALLGLGVVLVLSSFFALGFAGTFLGDYFGILKEARVTVFPFNILDNPMYWGSTANYLGWAIISPAPAGAVGSEARQPHGPAPDGAGGPHLHNGSPIRRALHR

SEQ ID NO: 867810 - protein, 1027 aa, Homo sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNDRGDSSTLTKQELKFIGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPVHRHPHFTQLPPTHFSPSMEIMQVRK

SEQ ID NO: 867811 - protein, 949 aa, Homo sapiens
MEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 867812 - protein, 990 aa, Homo sapiens
MKRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 867813 - protein, 949 aa, Homo sapiens; identical to SEQ ID NO: 867811

SEQ ID NO: 867814 - protein, 949 aa, Homo sapiens; identical to SEQ ID NO: 867811

SEQ ID NO: 867815 - protein, 949 aa, Homo sapiens; identical to SEQ ID NO: 867811

SEQ ID NO: 867816 - protein, 790 aa, Homo sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITAKSP

SEQ ID NO: 867817 - protein, 569 aa, Homo sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSGRGLPIIIFLLHSHHLPSSVPKRFQLLLR

SEQ ID NO: 867818 - protein, 179 aa, Homo sapiens
MVSSDRPVSLEDEVSHSMKEMIGGCCVCSDERGWAENPLVYCDGHGCSVAVHQACYGIVQVPTGPWFCRKCESQERAARVMVCNSCWLASSENVTPGYIEHHCACASPHPRCLVSNVPPVSGALMHCFWACLTTAAFFGPQSFTTCHMSFLVSRDILFYIYGFMPFISVVIWRFKKERW

SEQ ID NO: 867819 - protein, 61 aa, Homo sapiens
MKPPQMGSVPVMTQPTLIYSQPVMRPPNPFALYQEHRYSLCNLMEENGITPKRQVLKQQNP

SEQ ID NO: 867820 - protein, 616 aa, Homo sapiens
VVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVETYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEAGVVACLDSGPGAETFPSSLFS

SEQ ID NO: 867821 - protein, 126 aa, Homo sapiens
MRWGGFQIDLPSMEKVHISKTYTSTSNNSISGSLKRLEDTTARFTNANFQEVSAHTSSGKDVSETRGSEGKGKKSSAHSSGQRGRKPGGGRNPGTTVSAASPFPQGISDVLVKILVFKMVNNSYAL

SEQ ID NO: 867822 - protein, 1068 aa, Homo sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 867823 - protein, 1057 aa, Homo sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTSIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 867824 - protein, 949 aa, Homo sapiens; identical to SEQ ID NO: 867811

SEQ ID NO: 867825 - protein, 1007 aa, Homo sapiens
GSNCEPKVAPTTAWNAATMRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 867826 - protein, 949 aa, Homo sapiens; identical to SEQ ID NO: 867811

SEQ ID NO: 867827 - protein, 945 aa, Homo sapiens
VVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVETYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 867828 - protein, 371 aa, Homo sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGISDVLVKILVFKMVNNSYAL

SEQ ID NO: 867829 - protein, 1420 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 867830 - protein, 1420 aa, Homo sapiens; identical to SEQ ID NO: 867829

SEQ ID NO: 867831 - protein, 1420 aa, Homo sapiens; identical to SEQ ID NO: 867829

SEQ ID NO: 867832 - protein, 1420 aa, Homo sapiens; identical to SEQ ID NO: 867829

SEQ ID NO: 867833 - protein, 317 aa, Homo sapiens
MDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 867834 - protein, 317 aa, Homo sapiens; identical to SEQ ID NO: 867833

SEQ ID NO: 867835 - protein, 1310 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMLPKVPAKKITAASKKGSSPKRLPAQKSHRPEKQRLLQKLRKGSKGSSPESTCSKGIWQESISGNHKK

SEQ ID NO: 867836 - protein, 322 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSDGVLLCCPGWSAMVRSRLTATSTSWVQVIFLPWPPKQFGLQARATMPG

SEQ ID NO: 867837 - protein, 1420 aa, Homo sapiens; identical to SEQ ID NO: 867829

SEQ ID NO: 867838 - protein, 1420 aa, Homo sapiens; identical to SEQ ID NO: 867829

SEQ ID NO: 867839 - protein, 1415 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEVTSDGIFSPTAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 867840 - protein, 317 aa, Homo sapiens; identical to SEQ ID NO: 867833

SEQ ID NO: 867841 - protein, 317 aa, Homo sapiens; identical to SEQ ID NO: 867833

SEQ ID NO: 867842 - protein, 974 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPV

SEQ ID NO: 867843 - protein, 117 aa, Homo sapiens
MWVSWAPGLWLLGLWATFGHGANTGAQCPPSQQEGLKLEHSSSLPANVTGFNLIHRLSLMKKSAIKKIRNPKGPLILRLGAAPVTQPTALWEAKVGRSLEVRSSRPAWPAWRNPVST

SEQ ID NO: 867844 - protein, 116 aa, Homo sapiens
MRGSPGPPGPIVSISGALVCLRSSQRGHYTQTPSRGLVPKRLGKAGGGNFHCPPHPSAEHLQGLCSPTTGCPGTALLCLLPAVLLRGGPQRHLFASLSPPSAALSTVAPGRPRQGA

SEQ ID NO: 867845 - protein, 1589 aa, Homo sapiens
MWVSWAPGLWLLGLWATFGHGANTGAQCPPSQQEGLKLEHSSSLPANVTGFNLIHRLSLMKKSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPVSTVPWGSRKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 867846 - protein, 1690 aa, Homo sapiens
MWVSWAPGLWLLGLWATFGHGANTGAQCPPSQQEGLKLEHSSSLPANVTGFNLIHRLSLMKKSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPVSTVPWGSRKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKVSGHWLGLRGEAHEWMKPSCKLRLQPQRGDTGRPVGRGQKCRTWSRIVSENFSHGVISCGWGEGNLQFIYSLIDLIDSFIVSISRALPCSCSHSRPLSWPQGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 867847 - protein, 1045 aa, Homo sapiens
TQGWARVPPPVSMATSQGFPGDSRVPFGQAGLEPTLTGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPVSTVPWGSRKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 867848 - protein, 1086 aa, Homo sapiens
TQGWARVPPPVSMATSQGFPGDSRVPFGQAGLEPTLTGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPVSTVPWGSRKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 867849 - protein, 556 aa, Homo sapiens
MPPSKKVIFAWGGGLGQGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 867850 - protein, 366 aa, Homo sapiens
MGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 867851 - protein, 218 aa, Homo sapiens [sequence omitted]

SEQ ID NO: 867852 - protein, 1460 aa, Homo sapiens
MWVSWAPGLWLLGLWATFGHGANTGAQCPPSQQEGLKLEHSSSLPANVTGFNLIHRLSLMKKSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPVSTVPWGSRKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPVRTSAARPPLPPVSQGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPLERQGSMDSWSKVIQELLARMARPEEGESGMLGGPGKTGPCGCWSPGLPEKTHLDYGLGNPCSCGAWLWSPGTRANTRQRKHITVDTHHHASGTAWAEARPEGPSSITLLQTETENSRDDNTEMITSYTA

SEQ ID NO: 867853 - protein, 1140 aa, Homo sapiens
MWVSWAPGLWLLGLWATFGHGANTGAQCPPSQQEGLKLEHSSSLPANVTGFNLIHRLSLMKKSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPVSTVPWGSRKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIVSISGALVCLRSSQRGHYTQTPSRGLVPKRLGKAGGGNFHCPPHPSAEHLQGLCSPTTGCPGTALLCLLPAVLLRGGPQRHLFASLSPPSAALSTVAPGRPRQGA

SEQ ID NO: 867854 - protein, 1604 aa, Homo sapiens [sequence omitted]

SEQ ID NO: 867855 - protein, 46 aa, Homo sapiens
MGPPGFKGKTGHPGLPGPKGDCGKPGPPGSTGRPGAEVRARDPHGC

SEQ ID NO: 867856 - protein, 1095 aa, Homo sapiens
LRAGLECHLRSPWQPPRAFQETLGCLLGKLGWSPPLLSTWELSDKKGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPVSTVPWGSRKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 867857 - protein, 366 aa, Homo sapiens; identical to SEQ ID NO: 867850

SEQ ID NO: 867858 - protein, 366 aa, Homo sapiens; identical to SEQ ID NO: 867850

SEQ ID NO: 867859 - protein, 366 aa, Homo sapiens; identical to SEQ ID NO: 867850

SEQ ID NO: 867860 - protein, 218 aa, Homo sapiens [sequence omitted]

SEQ ID NO: 867861 - protein, 1565 aa, Homo sapiens
MWVSWAPGLWLLGLWATFGHGANTGAQCPPSQQEGLKLEHSSSLPANVTGFNLIHRLSLMKKSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPVSTVPWGSRKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 867862 - protein, 1195 aa, Homo sapiens
MWVSWAPGLWLLGLWATFGHGANTGAQCPPSQQEGLKLEHSSSLPANVTGFNLIHRLSLMKKSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPVSTVPWGSRKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGSQAFRATGPMDTQATVDHLATWLSREGRKGSKPSGCVVPGARTLDRGPRRGGWK

SEQ ID NO: 867863 - protein, 78 aa, Homo sapiens
SDFPSVALPSLGPQGPPGYGKMGATGPMGQQGIPGIPGPPGPMGQPGKAGHCNPSDCFGAMPMEQQYPPMKTMKGPFG

SEQ ID NO: 867864 - protein, 68 aa, Homo sapiens
LLTSSSEALSTFQGPLRVSEPIKGVIGLCMRGCCVWGSQSTENPTDLSRPRVLPFNLFLFSFHTGFRW

SEQ ID NO: 867865 - protein, 381 aa, Homo sapiens
MFQLAVDLPACEALGPGPEFWLLPRSPPRPPRLWSFRSGQPARVPAPVWSPRPPRVERIHGQMQMPRARRAHRPRDQAAALVPKAGLAKPPAAAKSSPSLASSSSSSSSAVAGGAPEQQALLRRGKRHLQGDGLSSFDSRGSRPTTETEFIAWGPTGDEEALESNTFPGVYGPTTVSILQTRKTTVAATTTTTTTATPMTLQTKGFTESLDPRRRIPGGVSTTEPSTSPSNNGEVTQPPRILGEASGLAVHQIITITVSLIMVIAALITTLVLKNCCAQSGNTRRNSHQRKTNQQEESCQNLTDFPSARVPSSLDIFTAYNETLQCSHECVRASVPVYTDETLHSTTGEYKSTFNGNRPSSSDRHLIPVAFVSEKWFEISC

SEQ ID NO: 867866 - protein, 411 aa, Homo sapiens
MWIQQLLGLSSMSIRWPGRPLGSHAWILIAMFQLAVDLPACEALGPGPEFWLLPRSPPRPPRLWSFRSGQPARVPAPVWSPRPPRVERIHGQMQMPRARRAHRPRDQAAALVPKAGLAKPPAAAKSSPSLASSSSSSSSAVAGGAPEQQALLRRGKRHLQGDGLSSFDSRGSRPTTETEFIAWGPTGDEEALESNTFPGVYGPTTVSILQTRKTTVAATTTTTTTATPMTLQTKGFTESLDPRRRIPGGVSTTEPSTSPSNNGEVTQPPRILGEASGLAVHQIITITVSLIMVIAALITTLVLKNCCAQSGNTRRNSHQRKTNQQEESCQNLTDFPSARVPSSLDIFTAYNETLQCSHECVRASVPVYTDETLHSTTGEYKSTFNGNRPSSSDRHLIPVAFVSEKWFEISC

SEQ ID NO: 867867 - protein, 411 aa, Homo sapiens; identical to SEQ ID NO: 867866

SEQ ID NO: 867868 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 867869 - protein, 553 aa, Homo sapiens; identical to SEQ ID NO: 867868

SEQ ID NO: 867870 - protein, 553 aa, Homo sapiens; identical to SEQ ID NO: 867868

SEQ ID NO: 867871 - protein, 527 aa, Homo sapiens [sequence omitted]

SEQ ID NO: 867872 - protein, 832 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867873 - protein, 899 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGKAVGPPILCFRSMDRRIENRMGTPAHRRRVVHTHRHTRNRLSCPWPPPFTSPTLTPGILLGTITLITELCERSPAALRHFRKVGLVKGQALGVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867874 - protein, 983 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGKAVGPPILCFRSMDRRIENRMGTPAHRRRVVHTHRHTRNRLSCPWPPPFTSPTLTPGILLGTITLITELCERSPAALRHFRKVGLVKGQALGVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRTGRGVGADGHGMIEPPTILTRYVALTSLLRLVQSDHSAVQRHRPTVVECLRETDASLSRLSSDRGDRRAGQRFPVPCGQDSSQFRAAGVRGLRGTGPWGSRGPEAWTRMTWATCMETLSPARRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867875 - protein, 859 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTVRQGPVRELGRSGQDSPHCLGHAHTFQAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867876 - protein, 797 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNKAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867877 - protein, 478 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGKAVGPPILCFRSMDRRIENRMGTPAHRRRVVHTHRHTRNRLSCPWPPPFTSPTLTPGILLGTITLITELCERSPAALRHFRKVGLVKGQALGVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSR

SEQ ID NO: 867878 - protein, 916 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGKAVGPPILCFRSMDRRIENRMGTPAHRRRVVHTHRHTRNRLSCPWPPPFTSPTLTPGILLGTITLITELCERSPAALRHFRKVGLVKGQALGVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERHHPACADNGEAGASQRAGQKWSRFTTLTGHAHTFQAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867879 - protein, 478 aa, Homo sapiens; identical to SEQ ID NO: 867877

SEQ ID NO: 867880 - protein, 832 aa, Homo sapiens; identical to SEQ ID NO: 867872

SEQ ID NO: 867881 - protein, 194 aa, Homo sapiens
GNVCLWRICALQRLLPILQVSAEQLQALASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867882 - protein, 832 aa, Homo sapiens; identical to SEQ ID NO: 867872

SEQ ID NO: 867883 - protein, 478 aa, Homo sapiens; identical to SEQ ID NO: 867877

SEQ ID NO: 867884 - protein, 322 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGKAVGPPILCFRSMDRRIENRMGTPAHRRRVVHTHRHTRNRLSCPWPPPFTSPTLTPGILLGTITLITELCERSPAALRHFRKVGW

SEQ ID NO: 867885 - protein, 55 aa, Homo sapiens
MPEMRSCLRQYSPSWISALQLAYGYHPLCLSHYGPAHHLTHTGPACWFLPPSPII

SEQ ID NO: 867886 - protein, 482 aa, Homo sapiens
HEELRRRAHCPSCWFSTLVLAPGVCKMKIEEVKSTTKTQRIASHSHVKGLGLDESGLAKQAASGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLRYSVQLLTPANLLAKINGKDSIEKEHVEEISELFYDAKSSAKILADQQDKYMK

SEQ ID NO: 867887 - protein, 962 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGKAVGPPILCFRSMDRRIENRMGTPAHRRRVVHTHRHTRNRLSCPWPPPFTSPTLTPGILLGTITLITELCERSPAALRHFRKVGLVKGQALGVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRLSSDRGDRRAGQRFPVPCGQDSSQFRAAGVRGLRGTGPWGSRGPEAWTRMTWATCMETLSPARRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867888 - protein, 906 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNKYRRGPSPLRDGLSLGPPIFEFLSRHTCPALPTPKPLGSCFGAKSGYFPAPWAFPSCHILQWHTAIATYILHWPSRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867889 - protein, 980 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGKAVGPPILCFRSMDRRIENRMGTPAHRRRVVHTHRHTRNRLSCPWPPPFTSPTLTPGILLGTITLITELCERSPAALRHFRKVGLVKGQALGVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRLSSDRGDRRAGQRFPVPCGQDSSQFRAAGVRGLRGTGPWGSRGPEAWTRMTWATCMETLSPARRALELSLALVNSSNVRAMMQELQGRGSQCPVAKTRASLEQLEKGTKGDRSLGKQRAWGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867890 - protein, 925 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGKAVGPPILCFRSMDRRIENRMGTPAHRRRVVHTHRHTRNRLSCPWPPPFTSPTLTPGILLGTITLITELCERSPAALRHFRKVGLVKGQALGVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERLRCPGVEEGRIWGASVPGLMSHISPRFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867891 - protein, 379 aa, Homo sapiens
RASVPREIRAACSIDTITACADKAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 867892 - protein, 794 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKVCKDQSSEVAWGLQEKRPLSGGGGWETV

SEQ ID NO: 867893 - protein, 794 aa, Homo sapiens; identical to SEQ ID NO: 867892

SEQ ID NO: 867894 - protein, 590 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNK

SEQ ID NO: 867895 - protein, 494 aa, Homo sapiens
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKKERVLAITWNQGDGRVGTLEIPGDCLLWVLKRTDFLRGLTDRPPKPCSDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTVRQGPVRELGRSGQDSPH

SEQ ID NO: 867896 - protein, 551 aa, Homo sapiens
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLPDENKGDMHYDAEIILKRETLLEIQKFLNGEDWKPGALDDALSDILINFKFHDFETWKWRFEDSFGVDPYNVLMVLLCLLCIVVLVATELWTYVRWYTQLRRVLIISFLFSLGWNWMYLYKLAFAQHQAEVAKMEPLNNVCAKKMDWTGSIWEWFRSSWTYKDDPCQKYYELLLVNPIWLVPPTKALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 867897 - protein, 551 aa, Homo sapiens; identical to SEQ ID NO: 867896

SEQ ID NO: 867898 - protein, 551 aa, Homo sapiens; identical to SEQ ID NO: 867896

SEQ ID NO: 867899 - protein, 551 aa, Homo sapiens; identical to SEQ ID NO: 867896

SEQ ID NO: 867900 - protein, 211 aa, Homo sapiens
MYFFSLQSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 867901 - protein, 501 aa, Homo sapiens
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLFHDFETWKWRFEDSFGVDPYNVLMVLLCLLCIVVLVATELWTYVRWYTQLRRVLIISFLFSLGWNWMYLYKLAFAQHQAEVAKMEPLNNVCAKKMDWTGSIWEWFRSSWTYKDDPCQKYYELLLVNPIWLVPPTKALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 867902 - protein, 122 aa, Homo sapiens
MYQTQRHESIPRWYPVINHLFWIQSPRRQVESWGKAHRKKAVLKAASRPSLSLAKTHQGIQKVHPQRKRPSSSLKPQAAQTKAAHTAPQEVWLDHVDRIRSAAPVARGTPAQTTASSLLRAL

SEQ ID NO: 867903 - protein, 551 aa, Homo sapiens; identical to SEQ ID NO: 867896

SEQ ID NO: 867904 - protein, 551 aa, Homo sapiens; identical to SEQ ID NO: 867896

SEQ ID NO: 867905 - protein, 551 aa, Homo sapiens; identical to SEQ ID NO: 867896

SEQ ID NO: 867906 - protein, 551 aa, Homo sapiens; identical to SEQ ID NO: 867896

SEQ ID NO: 867907 - protein, 551 aa, Homo sapiens; identical to SEQ ID NO: 867896

SEQ ID NO: 867908 - protein, 501 aa, Homo sapiens; identical to SEQ ID NO: 867901

SEQ ID NO: 867909 - protein, 225 aa, Homo sapiens [sequence omitted]

SEQ ID NO: 867910 - protein, 574 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867911 - protein, 574 aa, Homo sapiens; identical to SEQ ID NO: 867910

SEQ ID NO: 867912 - protein, 574 aa, Homo sapiens; identical to SEQ ID NO: 867910

SEQ ID NO: 867913 - protein, 574 aa, Homo sapiens; identical to SEQ ID NO: 867910

SEQ ID NO: 867914 - protein, 574 aa, Homo sapiens; identical to SEQ ID NO: 867910

SEQ ID NO: 867915 - protein, 525 aa, Homo sapiens
MTWRDIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867916 - protein, 520 aa, Homo sapiens
PTKASTRRVLIGRGRKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867917 - protein, 517 aa, Homo sapiens
MSPLVLSVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867918 - protein, 574 aa, Homo sapiens; identical to SEQ ID NO: 867910

SEQ ID NO: 867919 - protein, 481 aa, Homo sapiens
PTKASTRRVLIGRGSKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867920 - protein, 662 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLPHFIPLGGIGPFGKKPNPFLGNWWVVGWLELYPEPRVDVGPFKVLPVKEERLPSNWSLFPRNLFHSQNREISGTCFRGSLGGKRGRPPPWCPNTFTALILSPLLLLFALWIRIGANVSNFTFAPSTIIFHLGHAAMLGLMYVYWTQLNMFQTLKYLAILGSVTFLAGNRMLAQQAVKRTAH

SEQ ID NO: 867921 - protein, 606 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSAMLGLMYVYWTQLNMFQTLKYLAILGSVTFLAGNRMLAQQAVKRTAH

SEQ ID NO: 867922 - protein, 590 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLARVWSTVLESRSLFSKRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867923 - protein, 470 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSETAH

SEQ ID NO: 867924 - protein, 357 aa, Homo sapiens
QLTYINGSSRVGRRDPWDGPAAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867925 - protein, 316 aa, Homo sapiens
ALEYPHLLPHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867926 - protein, 416 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEWLPCVFPGMVGGPIPGTPADLEPSCPGCGAPFSYAGCPMATVRS

SEQ ID NO: 867927 - protein, 395 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGSVTFLAGNRMLAQQAVKRTAH

SEQ ID NO: 867928 - protein, 312 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRQSDAGPAGSQENSTLVPEERWKF

SEQ ID NO: 867929 - protein, 316 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLLLLRSACWDEKRGDLIIEFEVIFPERIPQTSRTVLEQVLPNSYLSSPRTDQGPFQSSRHPGPYYHVADHAEGAEGPGQAPRTADRPPEHISQPPKARTLDPRAPELLGHQVVGPARTQASRLPTARPPS

SEQ ID NO: 867930 - protein, 205 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQSASGMAEGETGGVHHLFNLCRNDFGHSHTAICGIPTDAD

SEQ ID NO: 867931 - protein, 160 aa, Homo sapiens [sequence omitted]

SEQ ID NO: 867932 - protein, 110 aa, Homo sapiens
MAPPGSSTVFLLALTIIASTWALTPTHYLTKHDVERLKASLDRPFTNLESAFYSIVGLSSLGAQVPDAKTSIGTYIQINQGRCDSKGHGPHGRGGVFMREGPKPLWADLP

SEQ ID NO: 867933 - protein, 302 aa, Homo sapiens
PTKASTRRVLIGRGSKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTR

SEQ ID NO: 867934 - protein, 142 aa, Homo sapiens
NHVILDGGMAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSP

SEQ ID NO: 867935 - protein, 574 aa, Homo sapiens; identical to SEQ ID NO: 867910

SEQ ID NO: 867936 - protein, 574 aa, Homo sapiens; identical to SEQ ID NO: 867910

SEQ ID NO: 867937 - protein, 574 aa, Homo sapiens; identical to SEQ ID NO: 867910

SEQ ID NO: 867938 - protein, 574 aa, Homo sapiens; identical to SEQ ID NO: 867910

SEQ ID NO: 867939 - protein, 542 aa, Homo sapiens
MAPPGSSTVFLLALTIIASTWALTPTHYLTKHDVERLKASLDRPFTNLESAFYSIVGLSSLGAQVPDAKISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867940 - protein, 574 aa, Homo sapiens; identical to SEQ ID NO: 867910

SEQ ID NO: 867941 - protein, 562 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867942 - protein, 599 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQWIRIGANVSNFTFAPSTIIFHLGHAAMLGLMYVYWTQLNMFQTLKYLAILGSVTFLAGNRMLAQQAVKRTAH

SEQ ID NO: 867943 - protein, 449 aa, Homo sapiens
MQRKHVPTSDLTLIPAMWIPSSTLPRPARPSQDVRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867944 - protein, 459 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFAFGSGLVPMSPTSLLLLARLYFTWDMLLCWDSCMSTGLSSTCSRP

SEQ ID NO: 867945 - protein, 514 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQQGAFCPDFPLTRKELRQGQVGVMVGRRPRRTTKRLYHTFRTLGDTRLAEQTICSFGTLCRLGSLKILHVYSSEYGTLERER

SEQ ID NO: 867946 - protein, 395 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTR

SEQ ID NO: 867947 - protein, 395 aa, Homo sapiens; identical to SEQ ID NO: 867946

SEQ ID NO: 867948 - protein, 261 aa, Homo sapiens
RARYPTCERHAFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSQYIHCPDPLAVASALRSVDPDWCQCLQLHFCS

SEQ ID NO: 867949 - protein, 187 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEAGSGLVPMSPTSLLLLARLYFTWDMLLCWDSCMSTGLSSTCSRP

SEQ ID NO: 867950 - protein, 172 aa, Homo sapiens
MATVVLGGDTMGPERIFPNQTEELGHQGPSEGTGDWSSEEPEEEQEETGSGPAGYSYQPLNQDPEQEEVELAPVGDGDVVADIQDRIQALGLHLPDPPLESEDEDEEGATALNNHSSIPMDPEHVELVKRTMAGVSLPAPGVPAWAREISDAQWEDVVQKALQARQASPAWK

SEQ ID NO: 867951 - protein, 186 aa, Homo sapiens
NSAGEAAALSAPARMATVVLGGDTMGPERIFPNQTEELGHQGPSEGTGDWSSEEPEEEQEETGSGPAGYSYQPLNQDPEQEEVELAPVGDGDVVADIQDRIQALGLHLPDPPLESEDEDEEGATALNNHSSIPMDPEHVELVKRTMAGVSLPAPGVPAWAREISDAQWEDVVQKALQARQASPAWK

SEQ ID NO: 867952 - protein, 185 aa, Homo sapiens
MGPERHLSGAPARMATVVLGGDTMGPERIFPNQTEELGHQGPSEGTGDWSSEEPEEEQEETGSGPAGYSYQPLNQDPEQEEVELAPVGDGDVVADIQDRIQALGLHLPDPPLESEDEDEEGATALNNHSSIPMDPEHVELVKRTMAGVSLPAPGVPAWAREISDAQWEDVVQKALQARQASPAWK

SEQ ID NO: 867953 - protein, 172 aa, Homo sapiens; identical to SEQ ID NO: 867950

SEQ ID NO: 867954 - protein, 172 aa, Homo sapiens; identical to SEQ ID NO: 867950

SEQ ID NO: 867955 - protein, 148 aa, Homo sapiens
NSAGEAAALSAPARMATVVLGGDTMGPERIFPNQTEELGHQGPSEGTGDWSSEEPEEEQEETGSGPAGYSYQPLNQDPEQEEVELAPVGDGDVVADIQDRIQALGLHLPDPPLESEDEDEEGATALNNHSSIPMDPVYRASRPVRTRP

SEQ ID NO: 867956 - protein, 185 aa, Homo sapiens; identical to SEQ ID NO: 867952

SEQ ID NO: 867957 - protein, 172 aa, Homo sapiens; identical to SEQ ID NO: 867950

SEQ ID NO: 867958 - protein, 115 aa, Homo sapiens
LGTLYWRCSLMVELAPVGDGDVVADIQDRIQALGLHLPDPPLESEDEDEEGATALNNHSSIPMDPEHVELVKRTMAGVSLPAPGVPAWAREISDAQWEDVVQKALQARQASPAWK

SEQ ID NO: 867959 - protein, 541 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 867960 - protein, 574 aa, Homo sapiens
NGHERVPRKLKCTFTSPKTPEHEGRYYECDVLPFMEMGSVAHKFYLLNIRLPVNEKKKINVGIGEIKDIRLVGIHQNGGFTKGVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 867961 - protein, 541 aa, Homo sapiens; identical to SEQ ID NO: 867959

SEQ ID NO: 867962 - protein, 437 aa, Homo sapiens
TFEWEKSSSWVRAVLPGLASEAGENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 867963 - protein, 264 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWAEWGVEYLTFFLF

SEQ ID NO: 867964 - protein, 264 aa, Homo sapiens; identical to SEQ ID NO: 867963

SEQ ID NO: 867965 - protein, 127 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIS

SEQ ID NO: 867966 - protein, 541 aa, Homo sapiens; identical to SEQ ID NO: 867959

SEQ ID NO: 867967 - protein, 644 aa, Homo sapiens
CDPLPCSFKRPQAAERPQSQLRALGEPEPAAPGESVRAPSVPVPSSPRSSTSEVLQRPERRRGRRECVRGGSKKLTLKHLFQGEKKKGGRKNGWGNYRKHEHQEAVHCWWDSARVPNHRLSGGRLDCIPINETIPNINSPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 867968 - protein, 541 aa, Homo sapiens; identical to SEQ ID NO: 867959

SEQ ID NO: 867969 - protein, 545 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGMQLPCKSREDCALFVSELYQELFSASKYSFINDNAASGI

SEQ ID NO: 867970 - protein, 356 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMVRAAGRDRRLYQLLCAGCQADTCPPLPLVSSG

SEQ ID NO: 867971 - protein, 103 aa, Homo sapiens
MQVYMEPPPPPPLSHSVRSECLHERASGRLAPPPQPVSQTRVSQPCFLAPRTRVAGPLQPRATGPYRAPPHQQEGGWLCPEPGGEAASPVCECRDLPEPPGPL

SEQ ID NO: 867972 - protein, 103 aa, Homo sapiens; identical to SEQ ID NO: 867971

SEQ ID NO: 867973 - protein, 34 aa, Homo sapiens
MPPVGPLISKGGFREQSEVKGLETQATQPAGAAE

SEQ ID NO: 867974 - protein, 103 aa, Homo sapiens; identical to SEQ ID NO: 867971

SEQ ID NO: 867975 - protein, 97 aa, Homo sapiens
PASAGLHCETCQSCFVKNNKVVTEICDLKTRLPSPQGSWASGKTGPCLPSRGCSLWEGEWVRPSLLRVEPRVGPGCHYRTEAVSRWAGPGWPLSLHL

SEQ ID NO: 867976 - protein, 103 aa, Homo sapiens; identical to SEQ ID NO: 867971

SEQ ID NO: 867977 - protein, 103 aa, Homo sapiens; identical to SEQ ID NO: 867971

SEQ ID NO: 867978 - protein, 708 aa, Homo sapiens
MSERGIKWACEYCTYENWPSAIKCTMCRAQRPSGTIITEDPFKSGSSDVGRDWDPSSTEGGSSPLICPDSSARPRVKSSYSMENANKWSCHMCTYLNWPRAIRCTQCLSQRRTRSPTESPQSSGSGSRPVAFSVDPCEEYNDRNKLNTRTQHWTCSVCTYENWAKAKRCVVCDHPRPNNIEAIELAETEEASSIINEQDRARWRGSCSSGNSQRRSPPATKRDSEVKMDFQRIELAGAVGSKEELEVDFKKLKQIKNRMKKTDWLFLNACVGVVEGDLAAIEAYKSSGGDIARQLTADEVRLLNRPSAFDVGYTLVHLAIRFQRQDMLAILLTEVSQQAAKCIPAMVCPELTEQIRREIAASLHQRKGDFACYILTDLVTFTLPADIEDLPPTVQEKLFDEVLDRDVQKELEEESPIINWSLELATRLDSRLYALWNRTAGDCLLDSVLQATWGIYDKDSVLRKALHDSLHDCSHWFYTRWKDWESWYSQSFGLHFSLREEQWQEDWAFILSLASQPGASLEQTHIFVLAHILRRPIIVYGVKYYKSFRGETLGYTRFQGVYLPLLWEQSFCWKSPIALGYTRGHFSALVAMENDGYGNRGAGANLNTDDDVTITFLPLVDSERKLLHVHFLSAQELGNEEQQEKLLREWLDCCVTEGGVLVAMQKSSRRRNHPLVTQMVEKWLDRYRQIRPCTSLSDGEEDEDDEDE

SEQ ID NO: 867979 - protein, 708 aa, Homo sapiens; identical to SEQ ID NO: 867978

SEQ ID NO: 867980 - protein, 117 aa, Homo sapiens
MENDGYGNRGAGANLNTDDDVTITFLPLVDSERKLLHVHFLSAQELGNEEQQEKLLREWLDCCVTEGGVLVAMQKSSRRRNHPLVTQMVEKWLDRYRQIRPCTSLSDGEEDEDDEDE

SEQ ID NO: 867981 - protein, 213 aa, Homo sapiens
GTGPESFGSEDWAFILSLASQPGASLEQTHIFVLAHILRRPIIVYGVKYYKSFRGETLGYTRFQGVYLPLLWEQSFCWKSPIALGYTRGHFSALVAMENDGYGNRGAGANLNTDDDVTITFLPLVDSERKLLHVHFLSAQELGNEEQQEKLLREWLDCCVTEGGVLVAMQKSSRRRNHPLVTQMVEKWLDRYRQIRPCTSLSDGEEDEDDEDE

SEQ ID NO: 867982 - protein, 256 aa, Homo sapiens [sequence omitted]

SEQ ID NO: 867983 - protein, 708 aa, Homo sapiens; identical to SEQ ID NO: 867978

SEQ ID NO: 867984 - protein, 708 aa, Homo sapiens; identical to SEQ ID NO: 867978

SEQ ID NO: 867985 - protein, 476 aa, Homo sapiens
MSERGIKWACEYCTYENWPSAIKCTMCRAQRPSGTIITEDPFKSGSSDVGRDWDPSSTEGGSSPLICPDSSARPRVKSSYSMENANKWSCHMCTYLNWPRAIRCTQCLSQRRTRSPTESPQSSGSGSRPVAFSVDPCEEYNDRNKLNTRTQHWTCSVCTYENWAKAKRCVVCDHPRPNNIEAIELAETEEASSIINEQDRARWRGSCSSGNSQRRSPPATKRDSEVKMDFQRIELAGAVGSKEELEVDFKKLKQIKNRMKKTDWLFLNACVGVVEGDLAAIEAYKSSGGDIARQLTADEVRLLNRPSAFDVGYTLVHLAIRFQRQDMLAILLTEVSQQAAKCIPAMVCPELTEQIRREIAASLHQRKGDFACYILTDLVTFTLPADIEDLPPTVQEKLFDEVLDRDVQKELEEESPIINWSLELATRLDSRLYALWNRTAGDCLLDSVLQATWGIYDKDSVLRKALHDSLHDCSHW

SEQ ID NO: 867986 - protein, 708 aa, Homo sapiens; identical to SEQ ID NO: 867978

SEQ ID NO: 867987 - protein, 708 aa, Homo sapiens; identical to SEQ ID NO: 867978

SEQ ID NO: 867988 - protein, 708 aa, Homo sapiens; identical to SEQ ID NO: 867978

SEQ ID NO: 867989 - protein, 708 aa, Homo sapiens; identical to SEQ ID NO: 867978

SEQ ID NO: 867990 - protein, 708 aa, Homo sapiens; identical to SEQ ID NO: 867978

SEQ ID NO: 867991 - protein, 423 aa, Homo sapiens
RETANCTPAPPGLAPLPNGAMSGSQARRCQVRAWTLRPSSAGLARTSPSSTLLSPVSSTCPSSPGFNPSLAKARVACGSQASALHTFHSPSPQSNLSPAQPSSSSSSSPGPIMAKDFQDIQQLSSEENDHPFHQGEGPGTRRLNPRRGNPFLKGPPPAQPLAQRLCSMVCFSLLALSFNILLLVVICVTGSQSEGHRGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 867992 - protein, 241 aa, Homo sapiens
LQEFGTEVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 867993 - protein, 169 aa, Homo sapiens
RETANCTPAPPGLAPLPNGAMSGSQARRCQVRAWTLRPSSAGLARTSPSSTLLSPVSSTCPSSPGFNPSLAKARVACGSQASALHTFHSPSPQSNLSPAQPSSSSSSSPGPIMAKDFQDIQQLSSEENDHPFHQGEGPGTRRLNPRRGNPFLKGKCAVSAALLPLCLSS

SEQ ID NO: 867994 - protein, 404 aa, Homo sapiens
RETANCTPAPPGLAPLPNGAMSGSQARRCQVRAWTLRPSSAGLARTSPSSTLLSPVSSTCPSSPGFNPSLAKARVACGSQASALHTFHSPSPQSNLSPAQPSSSSSSSPGPIMAKDFQDIQQLSSEENDHPFHQGPPPAQPLAQRLCSMVCFSLLALSFNILLLVVICVTGSQSEGHRGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 867995 - protein, 311 aa, Homo sapiens
MAKDFQDIQQLSSEENDHPFHQGEGPGTRRLNPRRGNPFLKGPPPAQPLAQRLCSMVCFSLLALSFNILLLVVICVTGSQSEGHRGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 867996 - protein, 292 aa, Homo sapiens
MAKDFQDIQQLSSEENDHPFHQGPPPAQPLAQRLCSMVCFSLLALSFNILLLVVICVTGSQSEGHRGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 867997 - protein, 247 aa, Homo sapiens
RWQLRVAGRGSRVAGRRSRRSLGAEVPGPGRGGRGLAREPRGLMAVADIKKVNNFIREQDLYALKSVKIPVRNHGILMETHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 867998 - protein, 296 aa, Homo sapiens
MRHEELLTKTFQGPAVVCGTPTSHVYMFKNGSGDSGDSSEEESHRVVLRPRGKERHKSGVHQPPQAGAGDVVLLQRELAQEDSLNKLALQYGCKVADIKKVNNFIREQDLYALKSVKIPVRNHGILMETHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 867999 - protein, 296 aa, Homo sapiens; identical to SEQ ID NO: 867998

SEQ ID NO: 868000 - protein, 247 aa, Homo sapiens; identical to SEQ ID NO: 867997

SEQ ID NO: 868001 - protein, 162 aa, Homo sapiens
RWQLRVAGRGSRVAGRRSRRSLGAEVADIKKVNNFIREQDLYALKSVKIPVRNHGILMETHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGKI

SEQ ID NO: 868002 - protein, 170 aa, Homo sapiens
METHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 868003 - protein, 326 aa, Homo sapiens
MRHEELLTKTFQGPAVVCGTPTSHVYMFKNGSGDSGDSSEEESHRVVLRPRGKERHKSGVHQPPQAGAGDVVLLQRELAQEDSLNKLALQYGCKHIYFRPNGAGDTRQNLIPDFYAFRVINNGKVADIKKVNNFIREQDLYALKSVKIPVRNHGILMETHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 868004 - protein, 114 aa, Homo sapiens
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGASLLMAAKVGVRMLMTSD

SEQ ID NO: 868005 - protein, 145 aa, Homo sapiens
PAFLPALPRPRGAARTQSRFRRDLAAVSRGLRSVVDSAGLRQMQAWGSLLSGLRREEWRSPSSHCSVPSLAAGLLFGSLAGLGAYQLYQDPRNVWGFLAATSVTFVGVMGMRSYYYGKFMPVGLIAGASLLMAAKVGVRMLMTSD

SEQ ID NO: 868006 - protein, 104 aa, Homo sapiens
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGARNLENCI

SEQ ID NO: 868007 - protein, 104 aa, Homo sapiens; identical to SEQ ID NO: 868006

SEQ ID NO: 868008 - protein, 114 aa, Homo sapiens; identical to SEQ ID NO: 868004

SEQ ID NO: 868009 - protein, 151 aa, Homo sapiens
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGARWSMALVAQAGVQWCDLSSLQPPPPRFKRFSCLTLLSSWDFRCAPPHPANFLYF

SEQ ID NO: 868010 - protein, 104 aa, Homo sapiens; identical to SEQ ID NO: 868006

SEQ ID NO: 868011 - protein, 104 aa, Homo sapiens; identical to SEQ ID NO: 868006

SEQ ID NO: 868012 - protein, 243 aa, Homo sapiens
MAASSISSPWGKHVFKAILMVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRLTGSRASGAQLEAKVRGLERQVEELRWRQRRAAKGARSVEEE

SEQ ID NO: 868013 - protein, 243 aa, Homo sapiens; identical to SEQ ID NO: 868012

SEQ ID NO: 868014 - protein, 165 aa, Homo sapiens
MAASSISSPWGKHVFKAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRLTGSRASGAQLEAKVRGLERQVEELRWRQRRAAKGARSVEEE

SEQ ID NO: 868015 - protein, 243 aa, Homo sapiens; identical to SEQ ID NO: 868012

SEQ ID NO: 868016 - protein, 76 aa, Homo sapiens
QRLSHACSTHGRMPHTPPVSYQRAELLRGHAALLPAPCPFLALSLNLQNIDPCRSPTSQEKQRKTIPPACPCGPVF

SEQ ID NO: 868017 - protein, 243 aa, Homo sapiens; identical to SEQ ID NO: 868012

SEQ ID NO: 868018 - protein, 207 aa, Homo sapiens
MAASSISSPWGKHVFKAILMVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRIPFPNNPSFYSPNTPPTTPQHQNHNSPILHTFTLSPFSQHYSNFPPLHI

SEQ ID NO: 868019 - protein, 243 aa, Homo sapiens; identical to SEQ ID NO: 868012

SEQ ID NO: 868020 - protein, 243 aa, Homo sapiens; identical to SEQ ID NO: 868012

SEQ ID NO: 868021 - protein, 224 aa, Homo sapiens
MTNWLPSAAASALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRLTGSRASGAQLEAKVRGLERQVEELRWRQRRAAKGARSVEEE

SEQ ID NO: 868022 - protein, 209 aa, Homo sapiens
QLIRLGTSAGLVARFSEVAREAQPWPGPDLPAVGSRGPGRLLAAVSAPRLGLGLAGADPVGPEACHLPGRLRGPDEVGARPFHPGPATPGLADPLRPAEPAHWLPSLWGPTRGQGARAGTPGGGAALAPEASGQGGPQCGGGVSRMPHTPPVSYQRAELLRGHAALLPAPCPFLALSLNLQNIDPCRSPTSQEKQRKTIPPACPCGPVF

SEQ ID NO: 868023 - protein, 80 aa, Homo sapiens
PTSPTAPTSPTAPTSPTAPTSPTAPTSPTGPTSPTALLPAPCPFLALSLNLQNIDPCRSPTSQEKQRKTIPPACPCGPVF

SEQ ID NO: 868024 - protein, 71 aa, Homo sapiens
GAYYYKIRGRVDRDPERGGRTRLLVCTTACTSLPIAPQPETEKELLTSAHPGSPGGTQAAPFPSRGLQRAG

SEQ ID NO: 868025 - protein, 106 aa, Homo sapiens
VTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 868026 - protein, 197 aa, Homo sapiens
GKGFTSISRLNRHRIIHTGEKLYNCNECGKALSSHSTLIIHERIHTGEKPCKCKVCGKASRQSSALIQHQRMHTGERPYKCNECDKTFRCNSSLSNHQRIHTGEKPYRCLECGMSFGQSAALIQHQRIHTGEKPFKCNTCGKTFRQSSSLIAHQRIHTGEKPYECNACGKLFSQRSSLTNHYKIHIEEDSLKADLHV

SEQ ID NO: 868027 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 868028 - protein, 125 aa, Homo sapiens
MEPGAESETLVLQTKILVGTSRPRMKPHFRNTVERMYRDTFSYNFYNRPILSRRNTVWLCYEVKTKGPSRPRLDAKIFRGQVPRSFIRAPFQVLSSPFGQCAPPHGTAQVQWPPQLTAGREQGRP

SEQ ID NO: 868029 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLQMLRDAGAQVSIMTYDEFKHCWDTFVDHQGCPFQPWDGLDEHSQDLSGRLRAILQNQEN

SEQ ID NO: 868030 - protein, 384 aa, Homo sapiens; identical to SEQ ID NO: 868027

SEQ ID NO: 868031 - protein, 384 aa, Homo sapiens; identical to SEQ ID NO: 868027

SEQ ID NO: 868032 - protein, 317 aa, Homo sapiens
MRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 868033 - protein, 196 aa, Homo sapiens
MKPHFRNTVERMYRDTFSYNFYNRPILSRRNTVWLCYEVKTKGPSRPPLDAKIFRGQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 868034 - protein, 235 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKR

SEQ ID NO: 868035 - protein, 127 aa, Homo sapiens
MRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILR

SEQ ID NO: 868036 - protein, 36 aa, Homo sapiens
MGTFTINRNVWARKKASGKSTVNAPATFQGLRAAQS

SEQ ID NO: 868037 - protein, 366 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGADHQGCPFQPWDGLDEHSQDLSGRLRAILQNQEN

SEQ ID NO: 868038 - protein, 317 aa, Homo sapiens; identical to SEQ ID NO: 868032

SEQ ID NO: 868039 - protein, 310 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSTAKT

SEQ ID NO: 868040 - protein, 131 aa, Homo sapiens
MPVFHCLAQLPGVPVNDTHRSLKEVRFLLDLIKQTKCDPSRLSWTGPFLPSPSAMLTFLSDGTGWEFRIHLDGVRSGDTSVHIFPFKKGSWPECSPSGHRLHVSVSVKAAMTISVTYSYSTMSIFTAGLYD

SEQ ID NO: 868041 - protein, 89 aa, Homo sapiens
SPKTEGAGRRQHTGLAVVPTDHPQLTPCPVMLPHDLCVLIQPSIESAQALLSLRVSAAPSGRRCLFGSALSLPVCAALGRLPYHMGLTK

SEQ ID NO: 868042 - protein, 69 aa, Homo sapiens
AAAGSGGSAQWQKCRLLLRRAVAEERFRLEFFVPPKVSYPIIPPSLGGPEEAPGQQLRVPGTAFGDRVV

SEQ ID NO: 868043 - protein, 101 aa, Homo sapiens
AAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPG

SEQ ID NO: 868044 - protein, 158 aa, Homo sapiens
LLPLVLNPRKKCKKKKYVNSGTVTLLSFSVDSEFTFVDYIKGGTQLNFTVAIDFTASNGNPLQPTSLHYMSPYQLSAYAMALKAVGEIIQDYDSDKLFPAYGFGAKLPPEGRISHQFPLNNNDEDPNCAGIEGVLESYFQSLRTVQLYGPTYFAPVIN

SEQ ID NO: 868045 - protein, 282 aa, Homo sapiens
MPLLTQQIQDEDDQYSLVASLDNVRNLSTILKAIHFREHATCFATKNGIKVTVENAKCVQANAFIQAGIFQEFKVQEESVTFRINLTVLLDCLSIFGSSPMPGTLTALRMCYQGYGYPLMLFLEEGGVVTVCKINTQEPEETLDFDFCSTNVINKIILQSEGLREAFSELDMTSEVLQITMSPDKPYFRLSTFGNAGSSHLDYPKDSDLMEAFHCNQTQVNRYKISLLKPSTKALVLSCKVSIRTDNRGFLSLQYMIRNEDGQICFVEYYCCPDEEVPESES

SEQ ID NO: 868046 - protein, 173 aa, Homo sapiens
MCYQGYGYPLMLFLEEGGVVTVCKINTQEPEETLDFDFCSTNVINKIILQSEGLREAFSELDMTSEVLQITMSPDKPYFRLSTFGNAGSSHLDYPKDSDLMEAFHCNQTQVNRYKISLLKPSTKALVLSCKVSIRTDNRGFLSLQYMIRNEDGQICFVEYYCCPDEEVPESES

SEQ ID NO: 868047 - protein, 173 aa, Homo sapiens; identical to SEQ ID NO: 868046

SEQ ID NO: 868048 - protein, 173 aa, Homo sapiens; identical to SEQ ID NO: 868046

SEQ ID NO: 868049 - protein, 155 aa, Homo sapiens
MVTVCKINTQEPEETLDFDFCSTNVINKIILQSEGLREAFSELDMTSEVLQITMSPDKPYFRLSTFGNAGSSHLDYPKDSDLMEAFHCNQTQVNRYKISLLKPSTKALVLSCKVSIRTDNRGFLSLQYMIRNEDGQICFVEYYCCPDEEVPESES

SEQ ID NO: 868050 - protein, 155 aa, Homo sapiens
MCYQGYGYPLMLFLEEGGVVTVCKINTQEPEETLDFDFCSTNVINKSEVLQITMSPDKPYFRLSTFGNAGSSHLDYPKDSDLMEAFHCNQTQVNRYKISLLKPSTKALVLSCKVSIRTDNRGFLSLQYMIRNEDGQICFVEYYCCPDEEVPESES

SEQ ID NO: 868051 - protein, 105 aa, Homo sapiens
MPLLTQQIQDEDDQYSLVASLDNVRNLSTILKAIHFREHATCFATKNGIKVTVENAKCVQANAFIQAGIFQEFKVQEESVTFRINLTVLLDCLSIFGSSPMPGKL

SEQ ID NO: 868052 - protein, 284 aa, Homo sapiens
MPLLTQQIQDEDDQYSLVASLDNVRNLSTILKAIHFREHATCFATKNGIKVTVENAKCVQANAFIQAGIFQEFKVQEESVTFRINLTVLLDCLSIFGSSPMPGTLTALRMCYQGYGYPLMLFLEEGGVVTVCKINTQEPEETLDFDFCSTNVINKIILQSEGLREAFSELDMTSEVLQITMSPDKPYFRLSTFGNAGSSHLDYPKDSDLMEAFHCNQTQVNRYKISLLKPSTKALVLSCKGLTFSSRLECSGTISAHCSLDLLGSSSLPSSASQSARITGNEPP

SEQ ID NO: 868053 - protein, 282 aa, Homo sapiens; identical to SEQ ID NO: 868045

SEQ ID NO: 868054 - protein, 282 aa, Homo sapiens; identical to SEQ ID NO: 868045

SEQ ID NO: 868055 - protein, 173 aa, Homo sapiens; identical to SEQ ID NO: 868046

SEQ ID NO: 868056 - protein, 173 aa, Homo sapiens; identical to SEQ ID NO: 868046

SEQ ID NO: 868057 - protein, 282 aa, Homo sapiens; identical to SEQ ID NO: 868045

SEQ ID NO: 868058 - protein, 76 aa, Homo sapiens
RNRGGSEGRLKCSRLTAVSSSWAQRWESPYVAQAGLQHLGSSGLASQSAGIIGLCRLLPVSVARHARLSRPPSALW

SEQ ID NO: 868059 - protein, 280 aa, Homo sapiens
MVRGWGAHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMRNPGLSGLPFKRDVIMAGSNVRDELANGGGKPCEVRHAPGKRSGK

SEQ ID NO: 868060 - protein, 103 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFE

SEQ ID NO: 868061 - protein, 1118 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 868062 - protein, 1168 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868063 - protein, 1168 aa, Homo sapiens; identical to SEQ ID NO: 868062

SEQ ID NO: 868064 - protein, 1232 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTVNIVNRYLVWNRAEGVSPLHLVQLVSLLVHLTRIGRFLQYLTVVFRSVTKPLDSSKISVSFGNEMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868065 - protein, 1118 aa, Homo sapiens; identical to SEQ ID NO: 868061

SEQ ID NO: 868066 - protein, 520 aa, Homo sapiens
RGKTPIGRYEAGCVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868067 - protein, 1147 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868068 - protein, 1168 aa, Homo sapiens; identical to SEQ ID NO: 868062

SEQ ID NO: 868069 - protein, 1168 aa, Homo sapiens; identical to SEQ ID NO: 868062

SEQ ID NO: 868070 - protein, 1291 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQGGSSLPSSCSGAHRLSRGTEHRAVLVWPAWERGQDWPPSQPPSVLPAWLLAAEFGVSGACLASVQGLQQPVFPSHQPLTLPGDVPTGSIKASVEGGQWRALGDGGSATFVCRLLAGQLLLCGQGSPVADAAVIGLKLFPESPKLPCICASGYGCPKLPGVVGGSCGGDTATPAENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 868071 - protein, 1087 aa, Homo sapiens
VLRGPAALIPYPPPQGLEAGSRRSQRTPPEPREGEEWRYTRHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 868072 - protein, 932 aa, Homo sapiens
MRAGGACRPGAAGTAAGTAAGGWDGGCGGAEPARCLTSPWCQWTGRGAATMTTSRGSVGWTTGSAPSWMTRTTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 868073 - protein, 128 aa, Homo sapiens
SRGSDGDQAEEEYYRKLAGLVEEMHAAYGKPVFLIGHSLGCLHLLYFLLRQPQAWKDRFIDGFISLGAPWGGSIKPMLVLASETGSHYIAQTGLELLGSSILLPQPPRVLALQALGGSSKKSACLFRC

SEQ ID NO: 868074 - protein, 223 aa, Homo sapiens
MTLEDKRQRTNRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868075 - protein, 1022 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRQVFLEPNCGRSVRGGS

SEQ ID NO: 868076 - protein, 1000 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREPSVKDRTRLAETCKDPLD

SEQ ID NO: 868077 - protein, 813 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTPCAALRLPTWPCSCPRTSPSTPATTSATWRAT

SEQ ID NO: 868078 - protein, 245 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINLSHLVSHYCLQPLCKVDALNTVRTDIVGVFLLNQEHC

SEQ ID NO: 868079 - protein, 599 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFFKSKGSHAFLVGLNEMSTVFFSFLDDTRIARLLGLLGKRSRASAASSPETQAGQGLSQPDPASFAPQAAMSGDSQIYASLGNAIAACKIDGTTQSNI

SEQ ID NO: 868080 - protein, 106 aa, Homo sapiens
YTFLGPPDNFRELVHIEADGSWRPVTGYTTCRDQSNVRRMHTAVKLNEVIVTRSHDARLVLLNMPGPPRNSEGDENYMEFLEVLTEGLERVLLVRGGGREVITIYS

SEQ ID NO: 868081 - protein, 216 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPGQ

SEQ ID NO: 868082 - protein, 1168 aa, Homo sapiens; identical to SEQ ID NO: 868062

SEQ ID NO: 868083 - protein, 79 aa, Homo sapiens
ASGRGVSARGGGDSGGDSGGRLGRRVRRGRARTMPHFTVVPVDGPRRGDYDNLEGLSWVDYGERAELDDSDDMATTERA

SEQ ID NO: 868084 - protein, 1112 aa, Homo sapiens
ILCSHSDVGERTSPIPQQRPLQSHAEMAGNHRLGLEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868085 - protein, 1011 aa, Homo sapiens
SSDPHHLIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868086 - protein, 878 aa, Homo sapiens
MNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868087 - protein, 751 aa, Homo sapiens
RKKVQKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868088 - protein, 947 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQV

SEQ ID NO: 868089 - protein, 1168 aa, Homo sapiens; identical to SEQ ID NO: 868062

SEQ ID NO: 868090 - protein, 888 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQL

SEQ ID NO: 868091 - protein, 1167 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPCVQQKQPQRHWNLGVEVGWGRQVVLDGPGVGTLLQDGSWRPVTGYTTCRDQSNVRRMHTAVKLNEVIVTRSHDARLVLLNMPGPPRNSEGDENYMEFLEVLTEGLERVLLVRGGGREVITIYS

SEQ ID NO: 868092 - protein, 1101 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENCIPLWRGRQLGGG

SEQ ID NO: 868093 - protein, 1082 aa, Homo sapiens
LWAMAAEGAVCGFVYLEGTAWAVPEDTEPLASCTLGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 868094 - protein, 1054 aa, Homo sapiens
MGDTLSPGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 868095 - protein, 1179 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGKGSPPPGGWCGFQTKKQVVWGWEGQPQVQVPAPLSPLADLWNQEQ

SEQ ID NO: 868096 - protein, 115 aa, Homo sapiens
MLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 868097 - protein, 1252 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVSPSALPHGLAAPRPSPGWGERYGNTDAARPALIGPRGQAAIHEELLRSALGLALTWAWSCLDPESSWPVQGSSKGERPGEVESGRLVTPIGIDTGAAWAPKAGPGGEGGQAVGLGPKVWNGGDRTQLPSWCTQVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 868098 - protein, 912 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQEIYFSRVGKRTKWHKGFKQQGIPKW

SEQ ID NO: 868099 - protein, 598 aa, Homo sapiens
ASGRGVSARGGGDSGGDSGGRLGRRVRRGRARTMPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVSPSALPHGLAAPRPSPGWGER

SEQ ID NO: 868100 - protein, 128 aa, Homo sapiens; identical to SEQ ID NO: 868073

SEQ ID NO: 868101 - protein, 190 aa, Homo sapiens
YVRVSLPPPPPAAGRPGAAVADDAREEEEEAAPPPPPPPPPRLAAARPPGSQPRPPAAGEAQAAADMNHQQQQQQQKAGEQQLSEPEDMEMEAGDTDDPPRITQNPVINGNVALSDGHNTAEEDMEDGKCLWFTASQWAETLSENRFRSMLGTSWVHPWVLLSVASFQEAVTEENPVWVLSFKIAYTIAR

SEQ ID NO: 868102 - protein, 713 aa, Homo sapiens
MDELAGGGGGGPGMAAPPRQQQGPGGNLGLSPGGNGAAGGGGPPASEGAGPAAGPELSRPQQNTIPGILHYIQHEWARFEMERAHWEVERAELQARIAFLQGERKGQENLKKDLVRRIKMLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPKQKGQEIKRSSGDVLETFNFLENADDSDEDEENDMIEGIPEGKDKHRMNKHKIGNEGLAADLTDDPDTEEALKEFDFLVTAEDGEGAGEARSSGDGTEWAEPITFPSGGGKSFIMGSDDVLLSVLGLGDLADLTVTNDADYSYDLPANKDAFRKTWNPKYTLRSHFDGVRALAFHPVEPVLVTASEDHTLKLWNLQKTVPAKKSASLDVEPIYTFRAHIGPVLSLAISSNGEQCFSGGIDATIQWWNMPSPSVDPYDTYEPNVLAGTLVGHTDAVWGLAYSGIKNQLLSCSADGTVRLWNPQEKLPCICTYNGDKKHGIPTSVDFIGCDPAHMVTSFNTGSAVIYDLETSQSLVILSSQVDSGLQSNNHINRVVSHPTLPVTITAHEDRHIKFFDNKTGKMIHSMVAHLDAVTSLAVDPNGIYLMSGSHDCSIRLWNLDSKTCVQEITAHRKKLDESIYDVAFHSSKAYIASAGADALAKVFV

SEQ ID NO: 868103 - protein, 678 aa, Homo sapiens
MLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPKQKGQEIKRSSGDVLETFNFLENADDSDEDEENDMIEGIPEGKDKHRMNKHKIGNEGLAADLTDDPDTEEALKEFDFLVTAEDGEGAGEARSSGDGTEWDKDDLSPTAEVWDVDQGLISKLKEQYKKERKGKKGVKRANRTKLYDMIADLGDDELPHIPSGIINQSRSASTRMTDHEGARAEEAEPITFPSGGGKSFIMGSDDVLLSVLGLGDLADLTVTNDADYSYDLPANKDAFRKTWNPKYTLRSHFDGVRALAFHPVEPVLVTASEDHTLKLWNLQKTVPAKKSASLDVEPIYTFRAHIGPVLSLAISSNGEQCFSGGIDATIQWWNMPSPSVDPYDTYEPNVLAGTLVGHTDAVWGLAYSGIKNQLLSCSADGTVRLWNPQEKLPCICTYNGDKKHGIPTSVDFIGCDPAHMVTSFNTGSAVIYDLETSQSLVILSSQVDSGLQSNNHINRVVSHPTLPVTITAHEDRHIKFFDNKTGKMIHSMVAHLDAVTSLAVDPNGIYLMSGSHDCSIRLWNLDSKTCVQEITAHRKKLDESIYDVAFHSSKAYIASAGADALAKVFV

SEQ ID NO: 868104 - protein, 236 aa, Homo sapiens [sequence omitted]

SEQ ID NO: 868105 - protein, 678 aa, Homo sapiens; identical to SEQ ID NO: 868103

SEQ ID NO: 868106 - protein, 678 aa, Homo sapiens; identical to SEQ ID NO: 868103

SEQ ID NO: 868107 - protein, 678 aa, Homo sapiens; identical to SEQ ID NO: 868103

SEQ ID NO: 868108 - protein, 300 aa, Homo sapiens
MDWFHCNQCFRKDGAHFFVTSCGHIFCKKCVTLEKCAVCGTACKHLALSDNLKPQEKMFFKSPVETALQYFSHISQVWSFQKKQTDLLIAFYKHRITKLETAMQEAQQALVSQDKELSVLRKENGELKKFLAILKESPSRYQGSRSITPRPVGITSPSQSVTPRPSFQHSSQVVSRSSSAESIPYREAGFGSLGQGGRGLQGRRTPRDSYNETPSPASTHSLSYRTSSASSGQGIFSFRPSPNGHSGHTRVLTPNNFAQRESTTTLESLPSFQLPVLQTLYQQRRHMGLPSGREAWTTSR

SEQ ID NO: 868109 - protein, 240 aa, Homo sapiens
MDWFHCNQCFRKDGAHFFVTSCGHIFCKKCVTLEKCAVCGTACKHLALSDNLKPQEKMFFKSPVETALQYFSHISQVWSFQKKQTDLLIAFYKHRITKLETAMQEAQQALVSQDNRSSSAESIPYREAGFGSLGQGGRGLQGRRTPRDSYNETPSPASTHSLSYRTSSASSGQGIFSFRPSPNGHSGHTRVLTPNNFAQRESTTTLESLPSFQLPVLQTLYQQRRHMGLPSGREAWTTSR

SEQ ID NO: 868110 - protein, 242 aa, Homo sapiens
MDWFHCNQCFRKDGAHFFVTSCGHIFCKKCVTLEKCAVCGTACKHLALSDNLKPQEKMFFKSPVETALQYFSHISQVWSFQKKQTDLLIAFYKHRITKLETAMQEAQQALVSQDKELSVLRKENGELKKFLAILKESPSRYQGSRSITPRPVGITSPSQSVGPPQRNLFLIERLALVAWDKEAEVCREGELPETLIMNFICLLWTGDFFFQTIPKWAFRPHKSPHPQQFCSEGEHNYTRESS

SEQ ID NO: 868111 - protein, 144 aa, Homo sapiens
WTAKDGQHRGGGQHRGGGQHRRPRGLKGRSLVPSPLQDTRWGPCALAGGRLQPPRPNVTFTHSLSSCPPVTPSPPSPSSHHPFRSARAFPEASCDSGRGDTSLRGRPHGVTRPAPMRIRPPLHLGALAARFPLTPLFRVLLNSG

SEQ ID NO: 868112 - protein, 412 aa, Homo sapiens
APHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPHSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 868113 - protein, 412 aa, Homo sapiens; identical to SEQ ID NO: 868112

SEQ ID NO: 868114 - protein, 684 aa, Homo sapiens
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHYLLGNFRDAVIAHEQRLLIAKEFGDKAAERRAYSNLGNAYIFLGEFETASEYYKKTLLLARQLKDRAVEAQSCYSLGNTYTLLQDYEKAIDYHLKHLAIAQELNDRIGEGRACWSLGNAYTALGNHDQAMHFAEKHLEISREVGDKSGELTARLNLSDLQMVLGLSYSTNNSIMSENTEIDSSLNGVRPKLGRRHSMENMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQGSRLDDQRCAPPPATTKGPTVPDEDFFSLILRSQGKRMDEQRVLLQRDQNRDTDFGLKDFLQNNALLEFKNSGKKSADH

SEQ ID NO: 868115 - protein, 684 aa, Homo sapiens; identical to SEQ ID NO: 868114

SEQ ID NO: 868116 - protein, 684 aa, Homo sapiens; identical to SEQ ID NO: 868114

SEQ ID NO: 868117 - protein, 684 aa, Homo sapiens; identical to SEQ ID NO: 868114

SEQ ID NO: 868118 - protein, 665 aa, Homo sapiens
MEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHYLLGNFRDAVIAHEQRLLIAKEFGDKAAERRAYSNLGNAYIFLGEFETASEYYKKTLLLARQLKDRAVEAQSCYSLGNTYTLLQDYEKAIDYHLKHLAIAQELNDRIGEGRACWSLGNAYTALGNHDQAMHFAEKHLEISREVGDKSGELTARLNLSDLQMVLGLSYSTNNSIMSENTEIDSSLNGVRPKLGRRHSMENMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQGSRLDDQRCAPPPATTKGPTVPDEDFFSLILRSQGKRMDEQRVLLQRDQNRDTDFGLKDFLQNNALLEFKNSGKKSADH

SEQ ID NO: 868119 - protein, 684 aa, Homo sapiens; identical to SEQ ID NO: 868114

SEQ ID NO: 868120 - protein, 627 aa, Homo sapiens
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHYLLGNFRDAVIAHEQRLLIAKEFGDKAAERRAYSNLGNAYIFLGEFETASEYYKKTLLLARQLKDRAVEAQSCYSLGNTYTLLQDYEKAIDYHLKHLAIAQELNDRIGEGRACWSLGNAYTALGNHDQAMHFAEKHLEISREVGDKSGELTARLNLSDLQMVLGLSYSTNNSIMSENTEIDSSLNGVRPKLGRRHSMENMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQVCLYIFFVLHTAQIPLKTLVVL

SEQ ID NO: 868121 - protein, 639 aa, Homo sapiens
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHYLLGNFRDAVIAHEQRLLIAKEFGDKAAERRAYSNLGNAYIFLGEFETASEYYKKTLLLARQLKDRAVEAQSCYSLGNTYTLLQDYEKAIDYHLKHLAIAQELNDRIGEGRACWSLGNAYTALGNHDQAMHFAEKHLEISREVGDKSGELTARLNLSDLQMVLGLSYSTNNSIMSENTEIDSSLNGVRPKLGRRHSMENMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQGSRLDDQRTNNRRSGFMPFSFFPEMLTLIYSLCR

SEQ ID NO: 868122 - protein, 684 aa, Homo sapiens; identical to SEQ ID NO: 868114

SEQ ID NO: 868123 - protein, 684 aa, Homo sapiens; identical to SEQ ID NO: 868114

SEQ ID NO: 868124 - protein, 684 aa, Homo sapiens; identical to SEQ ID NO: 868114

SEQ ID NO: 868125 - protein, 632 aa, Homo sapiens
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHYLLGNFRDAVIAHEQRLLIAKEFGDKAAERRAYSNLGNAYIFLGEFETASEYYKIGEGRACWSLGNAYTALGNHDQAMHFAEKHLEISREVGDKSGELTARLNLSDLQMVLGLSYSTNNSIMSENTEIDSSLNGVRPKLGRRHSMENMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQGSRLDDQRCAPPPATTKGPTVPDEDFFSLILRSQGKRMDEQRVLLQRDQNRDTDFGLKDFLQNNALLEFKNSGKKSADH

SEQ ID NO: 868126 - protein, 684 aa, Homo sapiens; identical to SEQ ID NO: 868114

SEQ ID NO: 868127 - protein, 253 aa, Homo sapiens
RNLILALWYTNCKEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQLGISMHKFGERCDLIQEGGRITDPTIDKRMDFHFNALLDVVSEWRKDKTQLQDVPLGEKIEEIYKAFIKESGIQFSELEGQVLQFHLSNLEYACGSNLHQVRLGFVKGVL

SEQ ID NO: 868128 - protein, 513 aa, Homo sapiens
RNLILALWYTNCKEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQLGISMHKFGERCDLIQEGGRITDPTIDKRMDFHFNALLDVVSEWRKDKTQLQDVPLGEKIEEIYKAFIKESGIQFSELEGQVLQFHLSNLEYACGSNLHQVSARSWDHNEFFAQFAGDHTLLTPGYSVIIEKLAEGLDIQLKSPQVQCIDYSGDEVQVTTTDGTGYSAQKVLVTVPLALLQKGAIQFNPPLSEKKMKAINSLGAGIIEKIALQFPYRFWDSKVQGADFFGHVPPSASKRGLFAVFYDMDPQKKHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 868129 - protein, 513 aa, Homo sapiens; identical to SEQ ID NO: 868128

SEQ ID NO: 868130 - protein, 321 aa, Homo sapiens
RNLILALWYTNCKEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQLGISMHKFGERCDLIQEGGRITDPTIDKRMDFHFNALLDVVSEWRKDKTQLQDVPLGEKIEEIYKAFIKESGIQFSELEGQVLQFHLSNLEYACGSNLHQVSARSWDHNEFFAQFAGDHTLLTPGYSVIIEKLAEGLDIQLKSPQVQCIDYSGDEVQVTTTDGTGYSAQKVLVTVPLV

SEQ ID NO: 868131 - protein, 513 aa, Homo sapiens; identical to SEQ ID NO: 868128

SEQ ID NO: 868132 - protein, 321 aa, Homo sapiens; identical to SEQ ID NO: 868130

SEQ ID NO: 868133 - protein, 600 aa, Homo sapiens
RRLVRHVRPPGLSALPRAWRGWGGGDQDLLRLRCGRSREAAAVAAAAATTAFGCRIWNPCAALTMKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDLFTSSVQMNPTDYINNTKSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 868134 - protein, 582 aa, Homo sapiens
RRLVRHVRPPGLSALPRAWRGWGGGDQDLLRLRCGRSREAAAVAAAAATTAFGCRIWNPCAALTMKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 868135 - protein, 461 aa, Homo sapiens
MASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 868136 - protein, 368 aa, Homo sapiens
MSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 868137 - protein, 199 aa, Homo sapiens
CCLPLQLMEVCENKRFVKRFVLPGSVFHLDDNINLLGKVELLDYLDSIDCSLEDFQAMLSGRQFSIDPDLLVDSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 868138 - protein, 582 aa, Homo sapiens; identical to SEQ ID NO: 868134

SEQ ID NO: 868139 - protein, 582 aa, Homo sapiens; identical to SEQ ID NO: 868134

SEQ ID NO: 868140 - protein, 294 aa, Homo sapiens
RRLVRHVRPPGLSALPRAWRGWGGGDQDLLRLRCGRSREAAAVAAAAATTAFGCRIWNPCAALTMKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVIF

SEQ ID NO: 868141 - protein, 570 aa, Homo sapiens
DLVNSTGAEFRELAFCRVALYLSSYCRQQRDPSRTVGYAFGCRIWNPCAALTMKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 868142 - protein, 196 aa, Homo sapiens [sequence omitted]

SEQ ID NO: 868143 - protein, 582 aa, Homo sapiens; identical to SEQ ID NO: 868134

SEQ ID NO: 868144 - protein, 582 aa, Homo sapiens; identical to SEQ ID NO: 868134

SEQ ID NO: 868145 - protein, 356 aa, Homo sapiens
MNGVSEGTRGCSDRQPGVLTRDRSCSRKMNSSGCLSEEVGSLRPLTVVILSASIVVGVLGNGLVLWMTVFRMARTVSTVCFFHLALADFMLSLSLPIAMYYIVSRQWLLGEWACKLYITFVFLSYFASNCLLVFISVDRCISVLYPVWALNHRTVQRASWLAFGVWLLAAALCSAHLKFRTTRKWNGCTHCYLAFNSDNETAQIWIEGVVEGHIIGTIGHFLLGFLGPLAIIGTCAHLIRAKLLREGWVHANRPKRLLLVLVSAFFIFWSPFNVVLLVHLWRRVMLKEIYHPRMLLILQASFALGCVNSSLNPFLYVFVGRDFQEKFFQSLTSALARAFGEEEFLSSCPRGNAPRE

SEQ ID NO: 868146 - protein, 148 aa, Homo sapiens
LGLSSLSLPICQTELKPPPLTWADSARISLQGRCELCRDLQCHSHLQPHLSPGRVTAKEAQRGGLAHLGSPSQWGQSIHLARVFSTCPCNRQGGEPAGSLGLGDLRGWGRSALSPEGSVSSALEHSCGAEEPHSEFPPHVVGGRTVIA

SEQ ID NO: 868147 - protein, 67 aa, Homo sapiens
PTVHFVRVDTDRTRCLGYSSVLVRSKDTAWKSGAPGMSTPPWRAPLWACVPVEAPFSGRRSQRESSF

SEQ ID NO: 868148 - protein, 111 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKARSCFLKKQDKQINK

SEQ ID NO: 868149 - protein, 271 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 868150 - protein, 271 aa, Homo sapiens; identical to SEQ ID NO: 868149

SEQ ID NO: 868151 - protein, 271 aa, Homo sapiens; identical to SEQ ID NO: 868149

SEQ ID NO: 868152 - protein, 271 aa, Homo sapiens; identical to SEQ ID NO: 868149

SEQ ID NO: 868153 - protein, 271 aa, Homo sapiens; identical to SEQ ID NO: 868149

SEQ ID NO: 868154 - protein, 272 aa, Homo sapiens
GLGPGPGWFAKGPWLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 868155 - protein, 292 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEVQWSGVFQSADVFCIPDDQIGLLSPLAQPEKSRSPGPSLMHSLAQTGRQPPCSRPRPLSSSRVALCSTSFQLTLLGHFFFFLNENTS

SEQ ID NO: 868156 - protein, 290 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVCRDGLLSVRTWALQALFQVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 868157 - protein, 183 aa, Homo sapiens
QARSQWGPGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 868158 - protein, 213 aa, Homo sapiens
PCGSWHVLPRWETQWATGFPAGLGPFPRVAAEGSTIPTPAAVDRGTPTVTGPVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 868159 - protein, 175 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKLQHMPACAVGQRRL

SEQ ID NO: 868160 - protein, 128 aa, Homo sapiens
NGNLVLHASEIHHPLGDGVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 868161 - protein, 140 aa, Homo sapiens
KGPCPHGAHVLKVAPKSCTVLSCRSHAGQKVETWPQGLGTGVVPWPSEEHPSWFGAGSLGTSDPHLPHPPVCLQECGLLRKGTVLLADNVICPGAPDFLAHVRGSSCFECTHYQSFLEYREVVDGLEKAIYKGPGSEAGP

SEQ ID NO: 868162 - protein, 74 aa, Homo sapiens
TSTGSPHEAKGLHHTASPLATRDYPQLRAMGLPYPWVSSKPAGRQQPESVSASVFCVVLEDPWAAWGSTQGQGV

SEQ ID NO: 868163 - protein, 292 aa, Homo sapiens; identical to SEQ ID NO: 868155

SEQ ID NO: 868164 - protein, 271 aa, Homo sapiens; identical to SEQ ID NO: 868149

SEQ ID NO: 868165 - protein, 271 aa, Homo sapiens; identical to SEQ ID NO: 868149

SEQ ID NO: 868166 - protein, 271 aa, Homo sapiens; identical to SEQ ID NO: 868149

SEQ ID NO: 868167 - protein, 271 aa, Homo sapiens; identical to SEQ ID NO: 868149

SEQ ID NO: 868168 - protein, 221 aa, Homo sapiens
MGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 868169 - protein, 305 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLENVAACARDPATGLNTRTCQETSIPRHVTRRTDDMHNYTTAGNTKQWDARTSQQRTRKKADSPDPQRNHQGRRTNTEKKNERQKHARDRHTKQTKTHTTHP

SEQ ID NO: 868170 - protein, 120 aa, Homo sapiens [sequence omitted]

SEQ ID NO: 868171 - protein, 290 aa, Homo sapiens; identical to SEQ ID NO: 868156

SEQ ID NO: 868172 - protein, 146 aa, Homo sapiens
MARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 868173 - protein, 111 aa, Homo sapiens; identical to SEQ ID NO: 868148

SEQ ID NO: 868174 - protein, 107 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCELTQPGTEGARRAPADLLRLRAVS

SEQ ID NO: 868175 - protein, 373 aa, Homo sapiens
MPPVPGVPFRNVDNDSPTSVELEDWVDAQHPTDEEEEEASSASSTLYLVFSPSSFSTSSSLILGGPEEEEVPSGVIPNLTESIPSSPPQGPPQGPSQSPLSSCCSSFSWSSFSEESSSQKGEDTGTCQGLPDSESSFTYTLDEKVAELVEFLLLKYEAEEPVTEAEMLMIVIKYKDYFPVILKRAREFMELLFGLALIEVGPDHFCVFANTVGLTDEGSDDEGMPENSLLIIILSVIFIKGNCASEEVIWEVLNAVGVYAGREHFVYGEPRELLTKVWVQGHYLEYREVPHSSPPYYEFLWGPRAHSESIKKKVLEFLAKLNNTVPSSFPSWYKDALKDVEERVQATIDTADDATVMASESLSVMSSNVSFSE

SEQ ID NO: 868176 - protein, 373 aa, Homo sapiens; identical to SEQ ID NO: 868175

SEQ ID NO: 868177 - protein, 289 aa, Homo sapiens
MPPVPGVPFRNVDNDSPTSVELEDWVDAQHPTDEEEGEDTGTCQGLPDSESSFTYTLDEKVAELVEFLLLKYEAEEPVTEAEMLMIVIKYKDYFPVILKRAREFMELLFGLALIEVGPDHFCVFANTVGLTDEGSDDEGMPENSLLIIILSVIFIKGNCASEEVIWEVLNAVGVYAGREHFVYGEPRELLTKVWVQGHYLEYREVPHSSPPYYEFLWGPRAHSESIKKKVLEFLAKLNNTVPSSFPSWYKDALKDVEERVQATIDTADDATVMASESLSVMSSNVSFSE

SEQ ID NO: 868178 - protein, 373 aa, Homo sapiens; identical to SEQ ID NO: 868175

SEQ ID NO: 868179 - protein, 373 aa, Homo sapiens; identical to SEQ ID NO: 868175

SEQ ID NO: 868180 - protein, 50 aa, Homo sapiens
MGLAAKGTGRLEELATGGSSCQGGKHGRAQGWDSLLDWVTLSPTLLPDTG

SEQ ID NO: 868181 - protein, 65 aa, Homo sapiens
MHSHMNSCKYRCSHTWIYAHAISPTRAHTCPHPHTYALTHTHAHTSTLTYTHAHTSLTHTHAHTG

SEQ ID NO: 868182 - protein, 120 aa, Homo sapiens
ESALGSLPPDPILLPHHHPKKLPQSQKMTSLPTSQRNLKLPERSPQLSSTYFQTYNLSVSSLLSSIPVKANSLLPSFGPISLSVFCSPLRESSPINNLFSLLCLLTHHLCLVPPWSFKHT

SEQ ID NO: 868183 - protein, 532 aa, Homo sapiens
PANATAPPLRWGPLRRVLSFSWELHVYGVGVLFLLPALLALAALAAAPAGPRLALVAAVLVLVASALRSAYMLTDPYGSQARLGVRGGLVLYNLPFPLLLTALAALTLLGLGAGLPPPLQNPLLLGAVALVHGVGLLATDLLSTWSVLNLLTQGLSCAWGAAVALGTLCLCRRRLLDGPRGWDASPGPRLLAVAGALGLLASGLQLAAALWLYPGPGRVGRFSWAWWGVHFWLRLLELTWALALALAAVAAARPRPPTEHACWAKLMRLACPAPSGKSEVPERPNNCYAGPSNVGAGSLDISKSLIRNPAESGQLATPSSGAWGSAASLGRGPQGGPGLSRNGVGPAPSLSELDLRPPSPINLSRSIDAALFREHLVRDSVFQRCGLRGLASPPPGGALRPRRGSHPKAELDDAGSSLLRGRCRSLSDVRVRGPVPQHVVEAPDGAAAAASGSSLDSFSRGSLKISWNPWRHGLSSVDSLPLDELPSTVQLLPAPTPAPDSTAARQGDGQGEVQPRGKPGESRSASSDTIEL

SEQ ID NO: 868184 - protein, 532 aa, Homo sapiens; identical to SEQ ID NO: 868183

SEQ ID NO: 868185 - protein, 532 aa, Homo sapiens; identical to SEQ ID NO: 868183

SEQ ID NO: 868186 - protein, 295 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868187 - protein, 295 aa, Homo sapiens; identical to SEQ ID NO: 868186

SEQ ID NO: 868188 - protein, 295 aa, Homo sapiens; identical to SEQ ID NO: 868186

SEQ ID NO: 868189 - protein, 295 aa, Homo sapiens; identical to SEQ ID NO: 868186

SEQ ID NO: 868190 - protein, 295 aa, Homo sapiens; identical to SEQ ID NO: 868186

SEQ ID NO: 868191 - protein, 330 aa, Homo sapiens
RELVSAGDRRGGRRGDLQVFPGSGSGALLSPFVAAMDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868192 - protein, 295 aa, Homo sapiens; identical to SEQ ID NO: 868186

SEQ ID NO: 868193 - protein, 150 aa, Homo sapiens
HVVPGRKRRAPVRRQRSRASFTDLCSAARPRLSLPRVRVRRFAESLCGRHGQFREGSGGDGAVGRGGAQSEELAVLLLWPLWRLIQNRGSMRNLRQSSKHVQNGQKLECCWKRVLPGCTAAPAAPEQARRSHLLCGRWQRIQESRPPRGH

SEQ ID NO: 868194 - protein, 284 aa, Homo sapiens
WFLCWWFLCWKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868195 - protein, 191 aa, Homo sapiens
MRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868196 - protein, 191 aa, Homo sapiens; identical to SEQ ID NO: 868195

SEQ ID NO: 868197 - protein, 191 aa, Homo sapiens; identical to SEQ ID NO: 868195

SEQ ID NO: 868198 - protein, 248 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868199 - protein, 189 aa, Homo sapiens
MRQSWWTSRRPLPTTSSLQTTTKARSPTGSPLPACPSPAGTATTSPHYSSPHSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868200 - protein, 189 aa, Homo sapiens; identical to SEQ ID NO: 868199

SEQ ID NO: 868201 - protein, 98 aa, Homo sapiens
RGQREGAGGLALDFAWPEFFYHCLAEARSPGFPGVPGSRPGVVAPHTPHTHTPQSPALLWAPVVGKSLGFVRPGSHSHPMSHRALGRSLPLSGSVSSL

SEQ ID NO: 868202 - protein, 159 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNR

SEQ ID NO: 868203 - protein, 191 aa, Homo sapiens; identical to SEQ ID NO: 868195

SEQ ID NO: 868204 - protein, 135 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQGEGLCGPHGLAVRSAILAPCIDSSGFLAALVFPVADM

SEQ ID NO: 868205 - protein, 111 aa, Homo sapiens
MRQSWWTSRRPLPTTSSLQTTTKARSPTGSPLPACPSPAGTATTSPHYSSPHSSANKCLLKVAGYAALLEQYQKAIDIYEQVGTGGDGGFHPAPSQGLCLLLSPGTLFWNH

SEQ ID NO: 868206 - protein, 113 aa, Homo sapiens
MRAIEIYTDMGRFTIAAKHHISIAEIYETELVDIEKAIAHYEQSADYYKGEESNSSANKCLLKVAGYAALLEQYQKAIDIYEQVGTGGDGGFHPAPSQGLCLLLSPGTLFWNH

SEQ ID NO: 868207 - protein, 174 aa, Homo sapiens
MNQLPAGPPVPGSGSGPLAACPELTSATSPWLQVGTNAMDSPLLKYSAKDYFFKAALCHFCIDMLNAKVAHPTPAGPPHQATMCLSPGQVPLPPKRDVLLPHVWPLPASLWMRSVVLTAVFLCWHHLPTQPWRLLRVQLLPHLVLFPSWVHFLNPHCTPLKSAPLSPRLMGEDG

SEQ ID NO: 868208 - protein, 295 aa, Homo sapiens; identical to SEQ ID NO: 868186

SEQ ID NO: 868209 - protein, 295 aa, Homo sapiens; identical to SEQ ID NO: 868186

SEQ ID NO: 868210 - protein, 295 aa, Homo sapiens; identical to SEQ ID NO: 868186

SEQ ID NO: 868211 - protein, 315 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTRYALLGLCHGACAMLITDRSLFLFCCYRH

SEQ ID NO: 868212 - protein, 299 aa, Homo sapiens
MSLHWTISGERECRMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868213 - protein, 356 aa, Homo sapiens
HVVPGRKRRAPVRRQRSRASFTDLCSAARPRLSLPRVRVRRFAESLCGRHGQFREGSGGDMIWPRRPGAPKVEKKTFPQGFPIFQFFQYIGAFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868214 - protein, 191 aa, Homo sapiens; identical to SEQ ID NO: 868195

SEQ ID NO: 868215 - protein, 319 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNRYPLPACPSPAGTATTSPHYSSPHSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868216 - protein, 302 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNRYPPSCLPQPRRDRHHFPSLLLPTQLSQQVSAEGGRRPLTSTNSGQASYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868217 - protein, 141 aa, Homo sapiens
MNQLPAGPPVPGSGSGPLAACPELTSATSPWLQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 868218 - protein, 275 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKWVSKFGSRSSFLIPDECENVSEGWEVPGEENLRGRPRGAQNPGAGPPGVSLRG

SEQ ID NO: 868219 - protein, 176 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKVSGSRALHGLAARTSAALSSSHQGSPLVSECREGGM

SEQ ID NO: 868220 - protein, 111 aa, Homo sapiens; identical to SEQ ID NO: 868205

SEQ ID NO: 868221 - protein, 44 aa, Homo sapiens
MRNLRQSSKHVQNGQKLEWYVISARAPPRCSPPPSASTHTGLPE

SEQ ID NO: 868222 - protein, 326 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 868223 - protein, 254 aa, Homo sapiens
CARAARPCGRVAPARDSPLPAAEVGGGRRPRRVRGAGMEHAPWSPGASSRARAGHTMNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTAPRHLLG

SEQ ID NO: 868224 - protein, 152 aa, Homo sapiens
ARPDSLGNGQPCQKGRCQWAGGRRESRSFLPPRAGPAAAHGDRSEFLPAGTPRPRTLVSSHPPPPAPWSRPREPSITLRSASIDSLRLPSPSWTRRSAEPPVRYGGREPGAGNRLLGGWESTARGSRPAGRSKGGHRRKGELGGPARLRPFP

SEQ ID NO: 868225 - protein, 326 aa, Homo sapiens; identical to SEQ ID NO: 868222

SEQ ID NO: 868226 - protein, 326 aa, Homo sapiens; identical to SEQ ID NO: 868222

SEQ ID NO: 868227 - protein, 326 aa, Homo sapiens; identical to SEQ ID NO: 868222

SEQ ID NO: 868228 - protein, 326 aa, Homo sapiens; identical to SEQ ID NO: 868222

SEQ ID NO: 868229 - protein, 326 aa, Homo sapiens; identical to SEQ ID NO: 868222

SEQ ID NO: 868230 - protein, 326 aa, Homo sapiens; identical to SEQ ID NO: 868222

SEQ ID NO: 868231 - protein, 430 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLSWVLFKQRLRQGASCGRLTERSEEQEESELHQSASPALSPEPACYSPSTSHWLRLPAGAEGPASQVFPKRQVLQQREGRNGQAEAIWVGHQQAQMDSMCPGPARRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 868232 - protein, 365 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTVRAGPAGPGGDLPGLGAGEGRGCWMEWLLLDTPHAHPLRLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 868233 - protein, 142 aa, Homo sapiens
MAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 868234 - protein, 365 aa, Homo sapiens; identical to SEQ ID NO: 868232

SEQ ID NO: 868235 - protein, 109 aa, Homo sapiens
NLSPWPGVASCSWLARLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 868236 - protein, 293 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTGEPRPG

SEQ ID NO: 868237 - protein, 293 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCWDPQNQLPSLSAFAWYP

SEQ ID NO: 868238 - protein, 90 aa, Homo sapiens
PRVLPTRRVGRGPKAAEGSEAGAHPQASVFSAPPCPRFRASVHREHHHHGQVEGFISPCQQLSSLVQVAWPAHWIGDGPGWARSGAQSGR

SEQ ID NO: 868239 - protein, 326 aa, Homo sapiens; identical to SEQ ID NO: 868222

SEQ ID NO: 868240 - protein, 326 aa, Homo sapiens; identical to SEQ ID NO: 868222

SEQ ID NO: 868241 - protein, 326 aa, Homo sapiens; identical to SEQ ID NO: 868222

SEQ ID NO: 868242 - protein, 326 aa, Homo sapiens; identical to SEQ ID NO: 868222

SEQ ID NO: 868243 - protein, 382 aa, Homo sapiens
CARAARPCGRVAPARDSPLPAAEVGGGRRPRRVRGAGMEHAPWSPGASSRARAGHTMNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 868244 - protein, 260 aa, Homo sapiens
MYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 868245 - protein, 389 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRELRQGASCGRLTERSEDEEESELHQSASPALSPEPACYSPSTSHWLRLPAGAEGPASQVFPKRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 868246 - protein, 224 aa, Homo sapiens
EEVEIIHADVLVTCSSNHAGVRCDLPRHSPGSPGAAPQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 868247 - protein, 198 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTAPRHLLG

SEQ ID NO: 868248 - protein, 212 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTETVCLDSDGGLGDEVARLSPG

SEQ ID NO: 868249 - protein, 126 aa, Homo sapiens
MSYKPIAPAPSSTPGSSTPGPGTPVPTGSVPSPSGSVPGAGAPFRPLFNDFGPPSMGYVQAMKPPGAQGSQSTYTDLLSVIEEMGKEIRPTYAGSKSAMERLKRGIIHARALVRECLAETERNART

SEQ ID NO: 868250 - protein, 138 aa, Homo sapiens
GAQGSGRQSPASFGPQSGEARKAPVAAATAAATATPAGPKLGRAEQTSEAARVRREGSARAREDPSARTGSPAPGPGSQGPASRAWGLIGLRARRPGPRTRQLRRAVATAQSGADRCEVRKAEANRRRLRPAGAGLGQ

SEQ ID NO: 868251 - protein, 126 aa, Homo sapiens; identical to SEQ ID NO: 868249

SEQ ID NO: 868252 - protein, 126 aa, Homo sapiens; identical to SEQ ID NO: 868249

SEQ ID NO: 868253 - protein, 101 aa, Homo sapiens
MGYVQAMKPPGAQGSQSTYTDLLSVIEEMGKEIRPTYAGSKSAMERLKREVSEARPPCSGNRHWTILHEGRKDIWRPPEPSLEDVQYYYQRGVLNRIEIES

SEQ ID NO: 868254 - protein, 126 aa, Homo sapiens; identical to SEQ ID NO: 868249

SEQ ID NO: 868255 - protein, 135 aa, Homo sapiens
MKHPLEGIGRTRSWAWKSWEAASLPRADLLLAPVAAGSVPSPSGSVPGAGAPFRPLFNDFGPPSMGYVQAMKPPGAQGSQSTYTDLLSVIEEMGKEIRPTYAGSKSAMERLKRGIIHARALVRECLAETERNART

SEQ ID NO: 868256 - protein, 105 aa, Homo sapiens
MSYKPIAPAPSSTPGSSTPGPGTPVPTGSVPSPSGSVPGAGAPFRPLFNDFGPPSMGYVQAMKPPGAQGSQSTYTDLLSVIEEMGKEIRPTYAGSKSAMERLKRA

SEQ ID NO: 868257 - protein, 138 aa, Homo sapiens; identical to SEQ ID NO: 868250

SEQ ID NO: 868258 - protein, 65 aa, Homo sapiens
QLAEKGDVPKAEKLGYNAPGFPQVHDVVKTTGPSGIVNTTQLKGEIGYPGREFGTSNGLILSCSF

SEQ ID NO: 868259 - protein, 391 aa, Homo sapiens [sequence omitted]

SEQ ID NO: 868260 - protein, 156 aa, Homo sapiens
FETGSCSAAQAGVAYLAYVANVKYLGECSNVLKTRDLSRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 868261 - protein, 151 aa, Homo sapiens
AILKSSQDPWDANGPHQCHPGDDTPHQRAPGNPAGLGNDHCQHCHQLQRQLRDPTADICVAVPILSLGLEPPTLPLIGTKGQEKRGNNRENESDTDVRHFLLNVSPKSQPRLPDSHLYYCRPVTLQDLPPPVPMTQLSKSIIIAPLIEDCW

SEQ ID NO: 868262 - protein, 120 aa, Homo sapiens
MRPEGFAEKNQVESGQSQGKSMAQLRHRGGASLTDGGKGAPRWGCRATMQAFSHWCSPVLSIANGPHQCHPGDDTPHQRAPGNPAGLGNDHCQHCHQLQRQLRDPTADICVAVPILSLGL

SEQ ID NO: 868263 - protein, 448 aa, Homo sapiens
MPGIKRILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 868264 - protein, 448 aa, Homo sapiens; identical to SEQ ID NO: 868263

SEQ ID NO: 868265 - protein, 1102 aa, Homo sapiens
MFQLPVNNLGSLRKARKTVKKILSDIGLEYCKEHIEDFKQFEPNDFYLKNTTWEDVGLWDPSLTKNQDYRTKPFCCSACPFSSKFFSAYKSHFRNVHSEDFENRILLNCPYCTFNADKKTLETHIKIFHAPNASAPSSSLSTFKDKNKNDGLKPKQADSVEQAVYYCKKCTYRDPLYEIVRKHIYREHFQHVAAPYIAKAGEKSLNGAVPLGSNAREESSIHCKRCLFMPKSYEALVQHVIEDHERIGYQVTAMIGHTNVVVPRSKPLMLIAPKPQDKKSMGLPPRIGSLASGNVRSLPSQQMVNRLSIPKPNLNSTGVNMMSSVHLQQNNYGVKSVGQGYSVGQSMRLGLGGNAPVSIPQQSQSVKQLLPSGNGRSYGLGSEQRSQAPARYSLQSANASSLSSGQLKSPSLSQSQASRVLGQSSSKPAAAATGPPPGNTSSTQKWKICTICNELFPENVYSVHFEKEHKAEKVPAVANYIMKIHNFTSKCLYCNRYLPTDTLLNHMLIHGLSCPYCRSTFNDVEKMAAHMRMVHIDEEMGPKTDSTLSFDLTLQQGSHTNIHLLVTTYNLRDAPAESVAYHAQNNPPVPPKPQPKVQEKADIPVKSSPQAAVPYKKDVGKTLCPLCFSILKGPISDALAHHLRERHQVIQTVHPVEKKLTYKCIHCLGVYTSNMTASTITLHLVHCRGVGKTQNGQDKTNAPSRLNQSPSLAPVKRTYEQMEFPLLKKRKLDDDSDSPSFFEEKPEEPVVLALDPKGHEDDSYEARKSFLTKYFNKQPYPTRREIEKLAASLWLWKSDIASHFSNKRKKCVRDCEKYKPGVLLGFNMKELNKVKHEMDFDAEWLFENHDEKDSRVNASKTADKKLNLGKEDDSSSDSFENLEEESNESGSPFDPVFEVEPKISNDNPEEHVLKVIPEDASESEEKLDQKEDGSKYETIHLTEEPTKLMHNASDSEVDQDDVVEWKDGASPSESGPGSQQVSDFEDNTCEMKPGTWSDESSQSEDARSSKPAAKKKATMQGDREQLKWKNSSYGKVEGFWSKDQSQWKNASENDERLSNPQIEWQNSTIDSEDGEQFDNMTDGVAEPMHGSLAGVKLSSQQA

SEQ ID NO: 868266 - protein, 874 aa, Homo sapiens
MPKSYEALVQHVIEDHERIGYQVTAMIGHTNVVVPRSKPLMLIAPKPQDKKSMGLPPRIGSLASGNVRSLPSQQMVNRLSIPKPNLNSTGVNMMSSVHLQQNNYGVKSVGQGYSVGQSMRLGLGGNAPVSIPQQSQSVKQLLPSGNGRSYGLGSEQRSQAPARYSLQSANASSLSSGQLKSPSLSQSQASRVLGQSSSKPAAAATGPPPGNTSSTQKWKICTICNELFPENVYSVHFEKEHKAEKVPAVANYIMKIHNFTSKCLYCNRYLPTDTLLNHMLIHGLSCPYCRSTFNDVEKMAAHMRMVHIDEEMGPKTDSTLSFDLTLQQGSHTNIHLLVTTYNLRDAPAESVAYHAQNNPPVPPKPQPKVQEKADIPVKSSPQAAVPYKKDVGKTLCPLCFSILKGPISDALAHHLRERHQVIQTVHPVEKKLTYKCIHCLGVYTSNMTASTITLHLVHCRGVGKTQNGQDKTNAPSRLNQSPSLAPVKRTYEQMEFPLLKKRKLDDDSDSPSFFEEKPEEPVVLALDPKGHEDDSYEARKSFLTKYFNKQPYPTRREIEKLAASLWLWKSDIASHFSNKRKKCVRDCEKYKPGVLLGFNMKELNKVKHEMDFDAEWLFENHDEKDSRVNASKTADKKLNLGKEDDSSSDSFENLEEESNESGSPFDPVFEVEPKISNDNPEEHVLKVIPEDASESEEKLDQKEDGSKYETIHLTEEPTKLMHNASDSEVDQDDVVEWKDGASPSESGPGSQQVSDFEDNTCEMKPGTWSDESSQSEDARSSKPAAKKKATMQGDREQLKWKNSSYGKVEGFWSKDQSQWKNASENDERLSNPQIEWQNSTIDSEDGEQFDNMTDGVAEPMHGSLAGVKLSSQQA

SEQ ID NO: 868267 - protein, 874 aa, Homo sapiens; identical to SEQ ID NO: 868266

SEQ ID NO: 868268 - protein, 107 aa, Homo sapiens [sequence omitted]

SEQ ID NO: 868269 - protein, 1102 aa, Homo sapiens; identical to SEQ ID NO: 868265

SEQ ID NO: 868270 - protein, 1102 aa, Homo sapiens; identical to SEQ ID NO: 868265

SEQ ID NO: 868271 - protein, 1102 aa, Homo sapiens; identical to SEQ ID NO: 868265

SEQ ID NO: 868272 - protein, 874 aa, Homo sapiens; identical to SEQ ID NO: 868266

SEQ ID NO: 868273 - protein, 891 aa, Homo sapiens
AAAGPGAARAKETAFVEVVLFESSPSGDYTTYTTGLTGRFSRAGATLSAEGEIVQMHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 868274 - protein, 128 aa, Homo sapiens
AAAGPGAARAKETAFVEVVLFESSPSGDYTTYTTGLTGRFSRAGATLSAEGEIVQVAARRPGPAPPPPQDGSGGCARRPRRGLPDWRAGGRGGREAGGIPPLRAGRRAGRGLRGASAGGERTWGLELL

SEQ ID NO: 868275 - protein, 655 aa, Homo sapiens
RQVKAGGYSDEGGICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 868276 - protein, 891 aa, Homo sapiens; identical to SEQ ID NO: 868273

SEQ ID NO: 868277 - protein, 891 aa, Homo sapiens; identical to SEQ ID NO: 868273

SEQ ID NO: 868278 - protein, 443 aa, Homo sapiens
AAAGPGAARAKETAFVEVVLFESSPSGDYTTYTTGLTGRFSRAGATLSAEGEIVQMHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLAALRRRRVLSGPTSLVPSRTLRSPAPLPLRLQDRDLTQQTAAAREPELRRNSYLEIGNCMETPN

SEQ ID NO: 868279 - protein, 891 aa, Homo sapiens; identical to SEQ ID NO: 868273

SEQ ID NO: 868280 - protein, 891 aa, Homo sapiens; identical to SEQ ID NO: 868273

SEQ ID NO: 868281 - protein, 108 aa, Homo sapiens [sequence omitted]

SEQ ID NO: 868282 - protein, 118 aa, Homo sapiens
MESRSVAQTGVHWHNLSSLQPLPPRFKQFSCLSLRSSWDYTHLPPCLANFFVFLVETAFRHVGQAGLKLLTSGDQPTSASQSAGITGISHRTQPVGRFLITDSIFLFVTDLLKFSISS

SEQ ID NO: 868283 - protein, 101 aa, Homo sapiens
SSTDCSSDPCRRRECVKLQRRRNRPLRSSPAATTHLCPWGPPCAPLRPGTETDWPGRHEAPRRTDSAAPTALQTLEGKDWAERRRAGQIPLTFLDLERSSK

SEQ ID NO: 868284 - protein, 315 aa, Homo sapiens
MQPESGANGTVIAEFILLGLLEAPGLQPVVFVLFLFAYLVTVRGNLSILAAVLVEPKLHTPMYFFLGNLSVLDVGCISVTVPSMLSRLLSRKRAVPCGACLTQLFFFHLFVGVDCFLLTAMAYDQFLAICRPLTYSTRMSQTVQRMLVAASWACAFTNALTHTVAMSTLNFCGPNVINHFYCDLPQLFQLSCSSTQLNELLLFAVGFIMAGTPMALIVISYIHVAAAVLRIRSVEGRKKAFSTCGSHLTVVAIFYGSGIFNYMRLGSTKLSDKDKAVGIFNTVINPMLNPIIYSFRNPDVQSAIWRMLTGRRSLA

SEQ ID NO: 868285 - protein, 377 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLCILKDVMEKLSTGVFRPQLDEPIPLYEAKVSMEAVQKNQGRKKQVVQF

SEQ ID NO: 868286 - protein, 187 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGQ

SEQ ID NO: 868287 - protein, 250 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGLAHHRGAKVISTACSLEDKQCLERFRPPIARVIDVSNGKVHVAESCLEETGGLGVDIVLDAGGRYLMKLVACVVFLV

SEQ ID NO: 868288 - protein, 330 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLS

SEQ ID NO: 868289 - protein, 329 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYL

SEQ ID NO: 868290 - protein, 330 aa, Homo sapiens; identical to SEQ ID NO: 868288

SEQ ID NO: 868291 - protein, 364 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLCILKDVMEKLSTGVFRPQSDEHIPVFEARIFFGNC

SEQ ID NO: 868292 - protein, 367 aa, Homo sapiens
QGAGSLTKDWKVAVVKVQAVGAAQRQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLCILKDVMEKLSTGVFRPQLDEPIPLYEAKVSMEAVQKNQGRKKQVVQF

SEQ ID NO: 868293 - protein, 295 aa, Homo sapiens
MKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLCILKDVMEKLSTGVFRPQLDEPIPLYEAKVSMEAVQKNQGRKKQVVQF

SEQ ID NO: 868294 - protein, 258 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVGSSR

SEQ ID NO: 868295 - protein, 265 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGGYIFQHSSYIFT

SEQ ID NO: 868296 - protein, 226 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIENSTIA

SEQ ID NO: 868297 - protein, 226 aa, Homo sapiens; identical to SEQ ID NO: 868296

SEQ ID NO: 868298 - protein, 377 aa, Homo sapiens; identical to SEQ ID NO: 868285

SEQ ID NO: 868299 - protein, 141 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVEVLSRLGAVAHVCNPSTLGGQGGRIT

SEQ ID NO: 868300 - protein, 141 aa, Homo sapiens; identical to SEQ ID NO: 868299

SEQ ID NO: 868301 - protein, 325 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQVKKQKHRDVDTDSRTQQVAEQESHSGSLSPF

SEQ ID NO: 868302 - protein, 226 aa, Homo sapiens; identical to SEQ ID NO: 868296

SEQ ID NO: 868303 - protein, 386 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLPNAPPPTPLDTLLPAPPPPPPPPPPPPPPPPPPPPPPPPPPPPPPPPPPPPPPHPPSPPETKNQGR

SEQ ID NO: 868304 - protein, 349 aa, Homo sapiens
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLCILKDVMEKLSTGVFRPQLDEPIPLYEAKVSMEAVQKNQGRKKQVVQF

SEQ ID NO: 868305 - protein, 127 aa, Homo sapiens
LNALYFIIFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIENSTIA

SEQ ID NO: 868306 - protein, 226 aa, Homo sapiens; identical to SEQ ID NO: 868296

SEQ ID NO: 868307 - protein, 268 aa, Homo sapiens
QGAGSLTKDWKVAVVKVQAVGAAQRQVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGGRYLMKLVACVVFLV

SEQ ID NO: 868308 - protein, 74 aa, Homo sapiens
CMIYRYLKKKDLRTGLLCEQQSWDSKAQFQIPHKTQLFSANNAANCEPTPTHNWASMFRELREAFIEKELLYLT

SEQ ID NO: 868309 - protein, 105 aa, Homo sapiens
QWWGWDLSQVFQLHNSRVRRAALLMGRGSELPVCLAFLVCLMAALGCCEVLSTVHPEETVLRAPPTNFQRCQLQQGSALVRETAWGVGRGRPSEKMAWRGWGLCS

SEQ ID NO: 868310 - protein, 372 aa, Homo sapiens
MTFQFNFTIEDHLENELTPIRDGALTLDSSKELSVSESQKGEERDRKCSAEQFDLPQDHLWEHKSMENAAPSQDTDSPLSAASSSRNLEPHGKQPSLRAAKEHAMPKDLKKMLENKVIETLPGFQHVKLSVVKTILLKENFPGENIVSKSFSSHSDLITGVYEGGLKIWECTFDLLAYFTKAKVKFAGKKVLDLGCGSGLLGITAFKGGSKEIHFQDYNSMVIDEVTLPNVVANSTLEDEENDVNEPDVKRCRKPKVTQLYKCRFFSGEWSEFCKLVLSSEKLFVKYDLILTSETIYNPDYYSNLHQTFLRLLSKNGRVLLASKAHYFGVGGGVHLFQKFVEERDVFKTRILKIIDEGLKRFIIEITFKFPG

SEQ ID NO: 868311 - protein, 372 aa, Homo sapiens; identical to SEQ ID NO: 868310

SEQ ID NO: 868312 - protein, 372 aa, Homo sapiens; identical to SEQ ID NO: 868310

SEQ ID NO: 868313 - protein, 378 aa, Homo sapiens
MTFQFNFTIEDHLENELTPIRDGALTLDSSKELSVSESQKGEERDRKCSAEQFDLPQDHLWEHKSMENAAPSQDTDSPLSAASSSRNLEPHGKQPSLRAAKEHAMPKDLKKMLENKVIETLPGFQHVKLSVVKTILLKENFPGENIVSKSFSSHSDLITGVYEGGLKIWECTFDLLAYFTKAKVKFAGKKVLDLGCGSGLLGITAFKGGSKEIHFQDYNSMVIDEVTLPNVVANSTLEDEENDVNEPDVKRCRKPKVTQLYKCRFFSGEWSEFCKLVLSSEKLFVKYDLILTSETIYNPDYYSNLHQTFLRLLSKNGRVLLASKAQSKEIHFQDYNSMVIDEVTLPNVVANSTLEDEENDVNEPDVKKMQETKSNTTI

SEQ ID NO: 868314 - protein, 128 aa, Homo sapiens
TNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPGRLQ

SEQ ID NO: 868315 - protein, 222 aa, Homo sapiens
MNPLLILTFVAAAVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 868316 - protein, 216 aa, Homo sapiens
ENSVPYQVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 868317 - protein, 161 aa, Homo sapiens
MNPLLILTFVAAAVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEAWSLHQGLQLCEMD

SEQ ID NO: 868318 - protein, 214 aa, Homo sapiens
MNPLLILTFVAAAVSLNSGYHFCGGSLINEQWVVSAGHCYKSRIQVRLGEHNIEVLEGNEQFINAAKIIRHPQYDRKTLNNDIMLIKARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 868319 - protein, 114 aa, Homo sapiens
PTRHLKFYNELIRDANESASAETENPQSSIIDSQGEQNGDIRRTDEVTIHQGNCTCGESGRGRERKTLTDSYCVYIEREDIRDSIWKKTCTLNNCFAEMLLICSFAPATLPQPL

SEQ ID NO: 868320 - protein, 121 aa, Homo sapiens
MAPRPLLLLLLLLGGSAARPAPPRARRHSDGTFTSELSRLREGARLQRLLQGLVGKRSEQDAENSMAWTRLSAGLLCPSGSNMPILQAWMPLDGTWSPWLPPGPMVSEPAGAAAEGTLRPR

SEQ ID NO: 868321 - protein, 539 aa, Homo sapiens
EVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 868322 - protein, 498 aa, Homo sapiens
EVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 868323 - protein, 377 aa, Homo sapiens
CGRGQAWLRRRGAAAAAVALPDARPSVPVPRWVTVDSQGAAGAGDRLLAEGEGVHPRRHTFQGARHSSRAVRLGSGAQKLLQAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 868324 - protein, 373 aa, Homo sapiens
MFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAGTVSVGTSSCLSLSQHPSPTSVFRHHYIPYFRGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 868325 - protein, 164 aa, Homo sapiens
EVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKTEERPGFAVRQSQVQI

SEQ ID NO: 868326 - protein, 445 aa, Homo sapiens
MTELRQRVAHEPVAPPEDKESESEAKVDGETASDSESRAESAPLPVSADDTPEVLNRALSNLSSRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 868327 - protein, 144 aa, Homo sapiens
MTELRQRVAHEPVAPPEDKESESEAKVDGETASDSESRAESAPLPVSADDTPEVLNRALSNLSSRWKNWWVRGILTLAMIAFFFIIIYLGPMVLMIIVSAISHYFSFPFSFCCRPGCLKCEVLGWLWELTGVQASQKTSAIEHL

SEQ ID NO: 868328 - protein, 367 aa, Homo sapiens
MIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 868329 - protein, 367 aa, Homo sapiens; identical to SEQ ID NO: 868328

SEQ ID NO: 868330 - protein, 457 aa, Homo sapiens
MTELRQRVAHEPVAPPEDKESESEAKVDGETASDSESRAESAPLPVSADDTPEVLNRALSNLSSRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWVRIGSWIFPFILFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 868331 - protein, 325 aa, Homo sapiens
MSRLRHPRTRYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 868332 - protein, 402 aa, Homo sapiens
MSRLRHPRTRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWVRIGSWIFPFILFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 868333 - protein, 133 aa, Homo sapiens
WACMHLNFYFIYSSQKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 868334 - protein, 445 aa, Homo sapiens; identical to SEQ ID NO: 868326

SEQ ID NO: 868335 - protein, 517 aa, Homo sapiens
GDARRGVVLFSDPLSQPTAAPGPGSAKGPRVPGLRGARVRGRRVGVPAQGLTEVAPPGRRKELLGSGARLLPRWAGCGDSPLPQLREAFLEESESEAKVDGETASDSESRAESAPLPVSADDTPEVLNRALSNLSSRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 868336 - protein, 452 aa, Homo sapiens
MTELRQRVAHEPVAPPEDKESESEAKVDGETASDSESRAESAPLPVSADDTPEVLNRALSNLSSRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWVMCHSQGKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 868337 - protein, 390 aa, Homo sapiens [sequence omitted]

SEQ ID NO: 868338 - protein, 185 aa, Homo sapiens
MVGTYFLAGLSVIPPQLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 868339 - protein, 193 aa, Homo sapiens
MQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKTEVFKGIRFPW

SEQ ID NO: 868340 - protein, 484 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 868341 - protein, 484 aa, Homo sapiens; identical to SEQ ID NO: 868340

SEQ ID NO: 868342 - protein, 467 aa, Homo sapiens
MQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 868343 - protein, 450 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 868344 - protein, 414 aa, Homo sapiens
RAWCGAQALGNRGVVSRGWRPGWRRPGRGSPKDRLPPAPRKRALVSVGVAERAVHETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 868345 - protein, 419 aa, Homo sapiens
MQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 868346 - protein, 484 aa, Homo sapiens; identical to SEQ ID NO: 868340

SEQ ID NO: 868347 - protein, 106 aa, Homo sapiens
SAEPAGACSGWNWGLHLPLRPQVGVTWSVKGRVSSPVCRTLETQPQSSPFSCMDLTYVSLLLQEFGFPRSKVLKLTRKIDNVETSWALGAIFHYIDSLNRQKSPAS

SEQ ID NO: 868348 - protein, 484 aa, Homo sapiens; identical to SEQ ID NO: 868340

SEQ ID NO: 868349 - protein, 120 aa, Homo sapiens
MFPPRGGARRSSARAAPTHFLLLDTEAAPPIEEGRLSYNKAEDARTGRAARYITERARCESARRQKRVPTRGRPHLWGGRERPPHLSVGGEGATQNYVWAGEQPLSLHEKENLLRRASRG

SEQ ID NO: 868350 - protein, 498 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRNNLTMFETQGLGALPWGGRGPHFFSISRSSALETGQDTVPSLH

SEQ ID NO: 868351 - protein, 395 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAGTGRVAACWFLRVRVVASSPPCLSHIPWDVPREAPDLSLKSLYLPWK

SEQ ID NO: 868352 - protein, 452 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAASLHELCAARVSEVLQNRVHRTEEVKHVDFYAFSYYYDLAAGVGLIDAEKEQLVVGGLRDRNKYVLSDPGKHGDKKPFHSDLTYVAWSPDRLPEATLSHRNGTWHLAWAFISSTESTWHRHQIDVHSDIRTHVISYN

SEQ ID NO: 868353 - protein, 350 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAGG

SEQ ID NO: 868354 - protein, 108 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDA

SEQ ID NO: 868355 - protein, 484 aa, Homo sapiens; identical to SEQ ID NO: 868340

SEQ ID NO: 868356 - protein, 90 aa, Homo sapiens
RAWCGAQALGNRGVVSRGWRPGWRRPGRGSPKDRLPPAPRKRALVSVGVAERAVHETPTLTHETFKALKPGLSAYADDVEKGAEPLELLQ

SEQ ID NO: 868357 - protein, 471 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYGGSHLEREGTCLIPSVSDPGDTAAEQPLLMHGPHLRQPATPGVRLSQEQSAEAHSEN

SEQ ID NO: 868358 - protein, 437 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAASLHELCAARVSEVLQNRVHRTEEVKHVDFYAFSYYYDLAAGVGLIDAEKGGSLVVGDFEIAAKYGGSHLEREGTCLIPSVSDPGDTAAEQPLLMHGPHLRQPATPGVRLSQEQSAEAHSEN

SEQ ID NO: 868359 - protein, 484 aa, Homo sapiens; identical to SEQ ID NO: 868340

SEQ ID NO: 868360 - protein, 366 aa, Homo sapiens
RAWCGAQALGNRGVVSRGWRPGWRRPGRGSPKDRLPPAPRKRALVSVGVAERAVHETPTLTHETFKALKPGLSAYADDVEKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 868361 - protein, 157 aa, Homo sapiens
MVRSPGPRESWGRIPRVEAGVAPAGAGEPKRPAAACSPEKGTRLRGCGGARGACNLTVLLQLGVVSPTDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 868362 - protein, 484 aa, Homo sapiens; identical to SEQ ID NO: 868340

SEQ ID NO: 868363 - protein, 129 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRDTSS

SEQ ID NO: 868364 - protein, 395 aa, Homo sapiens; identical to SEQ ID NO: 868351

SEQ ID NO: 868365 - protein, 395 aa, Homo sapiens; identical to SEQ ID NO: 868351

SEQ ID NO: 868366 - protein, 341 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGDRARLRLHLKKSRMMREMRQFQEGALRSVQVAA

SEQ ID NO: 868367 - protein, 111 aa, Homo sapiens
AYADDVEKVRILSRVSLFNCRMCSSQFFSFECGRLSSQRKGALTVLPGHFMPFGMVRREKVCSARAQRRTRPHPAPSSDSTVPALTSPTWGSRGLGTGQKHKSCKLTKIII

SEQ ID NO: 868368 - protein, 626 aa, Homo sapiens
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 868369 - protein, 501 aa, Homo sapiens
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGAWAALWWRC

SEQ ID NO: 868370 - protein, 626 aa, Homo sapiens; identical to SEQ ID NO: 868368

SEQ ID NO: 868371 - protein, 657 aa, Homo sapiens
MDEQEALNSIMNDLVALQMNRRHRMPGYETMKNKDTGHSNRQKKHNSSSSALLNSPTVTTSSCAGASEKKKFLSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 868372 - protein, 384 aa, Homo sapiens
KWLTLTYPEARIPLSYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 868373 - protein, 158 aa, Homo sapiens
MEGPRRGPEVGGFCKYRLLRVSRALCHDTSLGLTWLRTCSVRGFVRTLPFCLKLKAKENDRRLRTELTLAPGWEAAALLDATYCKWPEYQRGGFHGQMHSRCLPLHLDHLVVFKFLVPEAKSTTCLLVTCLPAVVVDVLAGRFGISHQSFCTVLVSSI

SEQ ID NO: 868374 - protein, 385 aa, Homo sapiens
PGDRWSCAARLGAACGRTPSSPPVCPGGLGVPACVPSVPSWPGVRGAGSGFAMAVRRDSVWKYCWGVLMVLCRTAISKSIVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFAGIASGCIIFIVIIITLVVLLLKYRRRHRKHSPQHTTTLSLSTLATPKRSGNNNGSEPSDIIIPLRTADSVFCPHYEKVSGDYGHPVYIVQEMPPQSPANIYYKV

SEQ ID NO: 868375 - protein, 385 aa, Homo sapiens; identical to SEQ ID NO: 868374

SEQ ID NO: 868376 - protein, 212 aa, Homo sapiens
MSPGPSGISWTMYTGARIPDLLVVRAEDAVPSPRDDNVLGSPLFVPLLGVASVLDSVVVFCGECFLFPRYFKRTTSVMMMTMKMMHPEAIPANKAIFGTEDVVPRMSGAVAQGSAAPHLRPPLHICITHGTLMSGVPSSSRWQQQLQSMGNPFIEIVFANKVPFSQMLGCLRRRLGVHRREWGWGKGWLQLQLTAAASETESWKGKKKKAIR

SEQ ID NO: 868377 - protein, 97 aa, Homo sapiens
DELGPKSDHTASRRHDSTHSGFQCMGRHSLLSNSDVQEEKPLFIPGNKDGYCWERNRLGGKGESRPLMIYSGRTVVVLAIRYTAPSCRRVGLLWMIF

SEQ ID NO: 868378 - protein, 385 aa, Homo sapiens; identical to SEQ ID NO: 868374

SEQ ID NO: 868379 - protein, 107 aa, Homo sapiens
MYNIYLQYILYISISYFCGAVAMVTSHSTYVILSITPTSPFCAFMQEFLVSHQKLLLGWGRGARRGKMGNSLILMKSNVCIISWLRFGSMLNCEKSDELIKEFPATN

SEQ ID NO: 868380 - protein, 405 aa, Homo sapiens
GDVTPSGDKAPPPGSGPGRRPARSGCPARGHSEPGGREEGGMPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQDGNYFEHKHNIRPKPFVIPGRSSGCSTPSGIDCGSGRSTPSSVSTVSTICPGDLKVAAKLAPNIPLEMELPGVKIVHAQFNTPMQLYSDDNIMETLQGQVSTALGETPLMSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 868381 - protein, 76 aa, Homo sapiens
EAVNRTRGPDWSVVGAVVKARDKYRHPECFVCADCNLNLKQKGYFFIEGELYCETHARARTKPPEGYDTVTLYPKA

SEQ ID NO: 868382 - protein, 357 aa, Homo sapiens
GDVTPSGDKAPPPGSGPGRRPARSGCPARGHSEPGGREEGGMPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQEFKPIGTAHNRRAQPFVAAANIDDKRQVVSASYNSPIGLYSTSNIQDALHGQLRGLIPSSPQNEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 868383 - protein, 214 aa, Homo sapiens
GDVTPSGDKAPPPGSGPGRRPARSGCPARGHSEPGGREEGGMPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQEFKPIGTAHNRRAQPFVAAANIDDKRQVVSASYNSPIGLYSTSNIQDALHGQLRGLIPSSPQK

SEQ ID NO: 868384 - protein, 214 aa, Homo sapiens; identical to SEQ ID NO: 868383

SEQ ID NO: 868385 - protein, 214 aa, Homo sapiens; identical to SEQ ID NO: 868383

SEQ ID NO: 868386 - protein, 230 aa, Homo sapiens
GDVTPSGDKAPPPGSGPGRRPARSGCPARGHSEPGGREEGGMPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQEFKPIGTAHNRRAQPFVAAANIDDKRQVVSASYNSPIGLYSTSNIQDALHGQLRGLIPSSPQKTGTTLNTSIIFGPNLS

SEQ ID NO: 868387 - protein, 357 aa, Homo sapiens; identical to SEQ ID NO: 868382

SEQ ID NO: 868388 - protein, 317 aa, Homo sapiens
GDVTPSGDKAPPPGSGPGRRPARSGCPARGHSEPGGREEGGMPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQDGNYFEHKHNIRPKPFVIPGRSSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 868389 - protein, 214 aa, Homo sapiens; identical to SEQ ID NO: 868383

SEQ ID NO: 868390 - protein, 248 aa, Homo sapiens
MRLIQNMCTIAEYPAPGNAAASDCCVGAAGRRLVKIAVVGASGVGKTALVVRFLTKRFIGDYERNAGNLYTRQVQIEGETLALQVQDTPGIQVHENSLSCSEQLNRCIRWADAVVIVFSITDYKSYELISQLHQHVQQLHLGTRLPVVVVANKADLLHIKQVDPQLGLQLASMLGCSFYEVSVSENYNDVYSAFHVLCKEVSHKQQPSSTPEKRRTSLIPRPKSPNMQDLKRRFKQALSAKVRTVTSV

SEQ ID NO: 868391 - protein, 113 aa, Homo sapiens
SGVWVWSLSPAEPRRSAPPRPYLHLFIVVISYRGAPQSGPPARSRAALAFSSPSVPSRAVRRSRGDAPHSEHVHHRRVPRAGQRRGLRLLCGRRRPPPGQDRRGGRQRRGQDR

SEQ ID NO: 868392 - protein, 113 aa, Homo sapiens; identical to SEQ ID NO: 868391

SEQ ID NO: 868393 - protein, 136 aa, Homo sapiens
FLELISQLRAAAHACNPSTLGGRGGQITRSRDRDHPGQHGETPSLPKIQKLTRRGGVHLWFQLLRRLRQENRLNLGGGGCGEPRSNHCTPAWAMRAKLSLKQTNKNKSVQQDCKIQNEHKIQNTLFLYTRNAHIKI

SEQ ID NO: 868394 - protein, 157 aa, Homo sapiens
MKIRGQKRGVTSVTQQACGRAGVQVVILSLPLAGPLCFVTSLQKVGLIPYIRPQAWPALFPPCPRPPAMPVRAVCEHSLERRYSLVSPLRPARKLISISFGDLNPFPLRQIRNRRAYHLEKVRLELTELEAIREDFLRERDTSPDKGELVSDEEEDT

SEQ ID NO: 868395 - protein, 401 aa, Homo sapiens
ALEDPWMLCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPRDYYTKTLLGSQVDQRVFRDLMSEKLPRLHGHFEQYKVDYTLITFNWFLVVFVDSVVSDILFKIWDSFLYEGPKVIFRFALALFKYKEEEILKLQDSMSIFKYLRYFTRTILDAEIRNRRAYHLEKVRLELTELEAIREDFLRERDTSPDKGELVSDEEEDT

SEQ ID NO: 868396 - protein, 102 aa, Homo sapiens [sequence omitted]

SEQ ID NO: 868397 - protein, 102 aa, Homo sapiens [sequence omitted]

SEQ ID NO: 868398 - protein, 927 aa, Homo sapiens
QGAAAEPGAGPAREPARLCGYLQKLSGKGPLRGYRSRWFVFDARRCYLYYFKSPQDALPLGHLDIADACFSYQGPDEAAEPGTEPPAHFQVHSAGAVTVLKAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDDQILGLTSQLERFSLEKESLQQEVRTLKSKVGELNEQLGMLMETIQAKDEVIIKLSEGEGNGPPPTVAPSSPSVVPVARDQLELDRLKDNLQGYKTQNKFLNKEILELSALRRNAERRERDLMAKYSSLEAKLCQIESKYLILLQEMKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPRDYYTKTLLGSQVDQRVFRDLMSEKLPRLHGHFEQYKVDYTLITFNWFLVVFVDSVVSDILFKIWDSFLYEGPKVIFRFALALFKYKEEEILKLQDSMSIFKYLRYFTRTILDAEIRNRRAYHLEKVRLELTELEAIREDFLRERDTSPDKGELVSDEEEDT

SEQ ID NO: 868399 - protein, 793 aa, Homo sapiens
QGAAAEPGAGPAREPARLCGYLQKLSGKGPLRGYRSRWFVFDARRCYLYYFKSPQDALPLGHLDIADACFSYQGPDEAAEPGTEPPAHFQVHSAGAVTVLKAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDDQILGLTSQLERFSLEKESLQQEVRTLKSKVGELNEQLGMLMETIQAKDEVIIKLSEGEGNGPPPTVAPSSPSVVPVARDQLELDRLKDNLQGYKTQNKFLNKEILELSALRRNAERRERDLMAKYSSLEAKLCQIESKYLILLQEMKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPSEVGQEKCLLLGRVRSKSSSICLAGLAP

SEQ ID NO: 868400 - protein, 927 aa, Homo sapiens; identical to SEQ ID NO: 868398

SEQ ID NO: 868401 - protein, 312 aa, Homo sapiens
MKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPRDYYTKTLLGSQVDQRVFRDLMSEKLPRLHGHFEQYKVDYTLITFNWFLVVFVDSVVSDILFKIWDSFLYEGPKVS

SEQ ID NO: 868402 - protein, 187 aa, Homo sapiens
AGVLEDPPPGSQVVRLLVCLPGDLAGLIHFSPLFPLQVDQRVFRDLMSEKLPRLHGHFEQYKVDYTLITFNWFLVVFVDSVVSDILFKIWDSFLYEGPKVIFRFALALFKYKEEEILKLQDSMSIFKYLRYFTRTILDAEIRNRRAYHLEKVRLELTELEAIREDFLRERDTSPDKGELVSDEEEDT

SEQ ID NO: 868403 - protein, 927 aa, Homo sapiens; identical to SEQ ID NO: 868398

SEQ ID NO: 868404 - protein, 789 aa, Homo sapiens
QGAAAEPGAGPAREPARLCGYLQKLSGKGPLRGYRSRWFVFDARRCYLYYFKSPQDALPLGHLDIADACFSYQGPDEAAEPGTEPPAHFQVHSAGAVTVLKAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDDQILGLTSQLERFSLEKESLQQEVRTLKSKVGELNEQLGMLMETIQAKDEVIIKLSEGEGNGPPPTVAPSSPSVVPVARDQLELDRLKDNLQGYKTQNKFLNKEILELSALRRNAERRERDLMAKYSSLEAKLCQIESKYLILLQEMKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPRDYYTKTLLGSQVVLKILCFSHHF

SEQ ID NO: 868405 - protein, 699 aa, Homo sapiens
QGAAAEPGAGPAREPARLCGYLQKLSGKGPLRGYRSRWFVFDARRCYLYYFKSPQDALPLGHLDIADACFSYQGPDEAAEPGTEPPAHFQVHSAGAVTVLKAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDDQILGLTSQLERFSLEKESLQQEVRTLKSKVGELNEQLGMLMETIQAKDEVIIKLSEGEGNGPPPTVAPSSPSVVPVARDQLELDRLKDNLQGYKTQNKFLNKEILELSALRRNAERRERDLMAKYSSLEAKLCQIESKYLILLQEMKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTSKHKDLRTKGFRLESCRSMVNLMDRDGHGKLGLVEFNI

SEQ ID NO: 868406 - protein, 1121 aa, Homo sapiens
TFTGQADCEPGSALGEPRPSHPFLGPLEGRYGFPVSPAASAPPSPHSETVKADAPGHSWAAFAQWMMGDYRLPDHPQPMEILNLYLGDSLEPHPGECPRETCSHEDPPEPFEEQTWATDPPEPTRQNVPPWGSGVELTHLGSWVHQDGLEPCQEQTRATDPPESTRQDAPPWGSGVELTHLGSPSAQREHRQNTASPGSPVNSHLPGSPKQNRSTSTQVVFWAGILQAQMCVLDLEEELEKTEGLKAGLKCCLPTPPVDLPGDTGLHSSPPENEDSGEDSSEPEGEGQAWLREGTPDSSPQWGAEEESMFFSNPLFLASPCSENSASGECFSWGASDSHAGVRTGPESPATLEPPLPEDTVLWELESEPDLGDGAAISGHCTPPFPVPIYKPHSICWASVAAAEGAPAAPPGHGESEGDRLGPAPSAAPCVDEALTWESGCVGSDLGPAAHPVQPWASLSPEGWQRGGPFWPQVTLNSQDRDEREGGHPQESLPCTLAPCPWRSPASSPEPSSPESESRGPGPRPSPASSQEGSPQLQHHSSGILPKWTLDASQSSLLETDGEQPSSLKKKEAGEAPKPGEEVKSEGTARPAETGDVQPDIHLTSAEHENLRTPMNSSWLPGSPMPQAQSPEEGQRPPAGDKLANGVRNNKVAWNLASRLYRLEGFRKSEVAAYLQKNNDFSRAVAEEYLSFFQFGGQSLDRALRSFLQALVLSGETQERERILYQFSRRFHHCNPGIFPSVDSVHTLTCAIMLLNTDLHGQNIGKSMSCQEFITNLNGLRDGGNFPKELLKALYWSIRSEKLEWAVDEEDTARPEKAQPSLPAGKMSKPFLQLAQDPTVPTYKQGILARKMHQDADGKKTPWGKRGWKMFHTLLRGMVLYFLKQGEDHCLEGESLVGQMVDEPVGVHHSLATPATHYTKKPHVFQLRTADWRLYLFQAPTAKEMSSWIARINLAAATHSAPPFPAAVGSQRRFVRPILPVGPAQSSLEEQHRSHENCLDAAADDLLDLQRNLPERRGRGRELEEHRLRKEYLEYEKTRYETYVQLLVARLHCPSDALDLWEEQLGREAGGTREPKLSLKKSHSSPSLHQDEAPTTAKVKRNISERRTYRKIIPKRNRNQL

SEQ ID NO: 868407 - protein, 1082 aa, Homo sapiens
AVLPGLGTRLGVYRQNVPPWGSGVELTHLGSWVHQDGLEPCQEQTRATDPPESTRQDAPPWGSGVELTHLGSPSAQREHRQNTASPGSPVNSHLPGSPKQNRSTSTQVVFWAGILQAQMCVLDLEEELEKTEGLKAGLKCCLPTPPVDLPGDTGLHSSPPENEDSGEDSSEPEGEGQAWLREGTPDSSPQWGAEEESMFFSNPLFLASPCSENSASGECFSWGASDSHAGVRTGPESPATLEPPLPEDTVLWELESEPDLGDGAAISGHCTPPFPVPIYKPHSICWASVAAAEGAPAAPPGHGESEGDRLGPAPSAAPCVDEALTWESGCVGSDLGPAAHPVQPWASLSPEGWQRGGPFWPQVTLNSQDRAKVLSPSVAWRLESWEPAVCCLCKWERSLPEGGQGMLPGSRGGAPGREPLEVVPRPFSCLLPCARLTSCSSSDEREGGHPQESLPCTLAPCPWRSPASSPEPSSPESESRGPGPRPSPASSQEGSPQLQHHSSGILPKWTLDASQSSLLETDGEQPSSLKKKEAGEAPKPGEEVKSEGTARPAETGDVQPDIHLTSAEHENLRTPMNSSWLPGSPMPQAQSPEEGQRPPAGDKLANGVRNNKVAWNLASRLYRLEGFRKSEVAAYLQKNNDFSRAVAEEYLSFFQFGGQSLDRALRSFLQALVLSGETQERERILYQFSRRFHHCNPGIFPSVDSVHTLTCAIMLLNTDLHGQNIGKSMSCQEFITNLNGLRDGGNFPKELLKALYWSIRSEKLEWAVDEEDTARPEKAQPSLPAGKMSKPFLQLAQDPTVPTYKQGILARKMHQDADGKKTPWGKRGWKMFHTLLRGMVLYFLKQGEDHCLEGESLVGQMVDEPVGVHHSLATPATHYTKKPHVFQLRTADWRLYLFQAPTAKEMSSWIARINLAAATHSAPPFPAAVGSQRRFVRPILPVGPAQSSLEEQHRSHENCLDAAADDLLDLQRNLPERRGRGRELEEHRLRKEYLEYEKTRYETYVQLLVARLHCPSDALDLWEEQLGREAGGTREPKLSLKKSHSSPSLHQDEAPTTAKVKRNISERRTYRKIIPKRNRNQL

SEQ ID NO: 868408 - protein, 1082 aa, Homo sapiens; identical to SEQ ID NO: 868407

SEQ ID NO: 868409 - protein, 287 aa, Homo sapiens
MHTCVCLSVSGCWCPHLQHLCSVPGTAPWGKRGWKMFHTLLRGMVLYFLKQGEDHCLEGESLVGQMVDEPVGVHHSLATPATHYTKKPHVFQLRTADWRLYLFQAPTAKEMSSWIARINLAAATHSAPPFPAAVGSQRRFVRPILPVGPAQSSLEEQHRSHENCLDAAADDLLDLQRNLPERRGRGRELEEHRLRKEYLEYEKTRYETYVQLLVARLHCPSDALDLWEEQLGREAGGTREPKLSLKKSHSSPSLHQDEAPTTAKVKRNISERRTYRKIIPKRNRNQL

SEQ ID NO: 868410 - protein, 172 aa, Homo sapiens
RRAAHLAWEPRRPGGRRARARKAAEGTPGTAPLTARCSQEEQHRSHENCLDAAADDLLDLQRNLPERRGRGRELEEHRLRKEYLEYEKTRYETYVQLLVARLHCPSDALDLWEEQLGREAGGTREPKLSLKKSHSSPSLHQDEAPTTAKVKRNISERRTYRKIIPKRNRNQL

SEQ ID NO: 868411 - protein, 373 aa, Homo sapiens
AVLPGLGTRLGVYRQNVPPWGSGVELTHLGSWVHQDGLEPCQEQTRATDPPESTRQDAPPWGSGVELTHLGSPSAQREHRQNTASPGSPVNSHLPGSPKQNRSTSTQVVFWAGILQAQMCVLDLEEELEKTEGLKAGLKCCLPTPPVDLPGDTGLHSSPPENEDSGEDSSEPEGEGQAWLREGTPDSSPQWGAEEESMFFSNPLFLASPCSENSASGECFSWGASDSHAGVRTGPESPATLEPPLPEDTVLWELESEPDLGDGAAISGHCTPPFPVPIYKPHSICWASVAAAEGAPAAPPGHGESEGDRLGPAPSAAPCVDEALTWESGCVGSDLGPAAHPVQPWASLSPEGWQRGGPFWPQVTLNSQDRGEP

SEQ ID NO: 868412 - protein, 130 aa, Homo sapiens
IGKSMSCQEFITNLNGLRDGGNFPKELLKVCATGSSYEPHVGPGALVLCSKGDAELGTGFAKISLREQDLFIEGLVKVYSLAGSIRSILEFVIHANLQAPCAGLIESDSLRLGPLKYFLKFSSHSYPFKV

SEQ ID NO: 868413 - protein, 1082 aa, Homo sapiens; identical to SEQ ID NO: 868407

SEQ ID NO: 868414 - protein, 435 aa, Homo sapiens
WLSRGSLPGCASESGRALRSFLQALVLSGETQERERILYQFSRRFHHCNPGIFPSVDSVHTLTCAIMLLNTDLHGQNIGKSMSCQEFITNLNGLRDGGNFPKELLKALYWSIRSEKLEWAVDEEDTARPEKAQPSLPAGKMSKPFLQLAQDPTVPTYKQGILARKMHQDADGKKTPWGKRGWKMFHTLLRGMVLYFLKQGEDHCLEGESLVGQMVDEPVGVHHSLATPATHYTKKPHVFQLRTADWRLYLFQAPTAKEMSSWIARINLAAATHSAPPFPAAVGSQRRFVRPILPVGPAQSSLEEQHRSHENCLDAAADDLLDLQRNLPERRGRGRELEEHRLRKEYLEYEKTRYETYVQLLVARLHCPSDALDLWEEQLGREAGGTREPKLSLKKSHSSPSLHQDEAPTTAKVKRNISERRTYRKIIPKRNRNQL

SEQ ID NO: 868415 - protein, 1082 aa, Homo sapiens; identical to SEQ ID NO: 868407

SEQ ID NO: 868416 - protein, 567 aa, Homo sapiens
AVLPGLGTRLGVYRQNVPPWGSGVELTHLGSWVHQDGLEPCQEQTRATDPPESTRQDAPPWGSGVELTHLGSPSAQREHRQNTASPGSPVNSHLPGSPKQNRSTSTQVVFWAGILQAQMCVLDLEEELEKTEGLKAGLKCCLPTPPVDLPGDTGLHSSPPENEDSGEDSSEPEGEGQAWLREGTPDSSPQWGAEEESMFFSNPLFLASPCSENSASGECFSWGASDSHAGVRTGPESPATLEPPLPEDTVLWELESEPDLGDGAAISGHCTPPFPVPIYKPHSICWASVAAAEGAPAAPPGHGESEGDRLGPAPSAAPCVDEALTWESGCVGSDLGPAAHPVQPWASLSPEGWQRGGPFWPQVTLNSQDRDEREGGHPQESLPCTLAPCPWRSPASSPEPSSPESESRGPGPRPSPASSQEGSPQLQHHSSGILPKWTLDASQSSLLETDGEQPSSLKKKEAGEAPKPGEEVKSEGTARPAETGDVQPDIHLTSAEHENLRTPMNSSWLPGSPMPQAQSPEEGQRPPAGDKLANGVRNNKVAWNLASRLYRLEGFRKSEVAAYLQKK

SEQ ID NO: 868417 - protein, 111 aa, Homo sapiens
RRNGRGGGAGRQPQAVRDAPRQPRRVRPAEAALRAVRCVRGAPAAIREAIQLPGLISSRGVRLGAGSQRARPRGLSRRQRGGDGGVPGQPSALASLLNIYALLNLLWTNHQ

SEQ ID NO: 868418 - protein, 749 aa, Homo sapiens
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKRMQKAAKIKKKANSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 868419 - protein, 749 aa, Homo sapiens; identical to SEQ ID NO: 868418

SEQ ID NO: 868420 - protein, 749 aa, Homo sapiens; identical to SEQ ID NO: 868418

SEQ ID NO: 868421 - protein, 749 aa, Homo sapiens; identical to SEQ ID NO: 868418

SEQ ID NO: 868422 - protein, 151 aa, Homo sapiens [sequence omitted]

SEQ ID NO: 868423 - protein, 116 aa, Homo sapiens
MCPRAWSWLPCGQRAPRQRNRSATTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 868424 - protein, 107 aa, Homo sapiens
MSITETNLQLATIIAMMKIMNYSHLYFCSIENKSFKAAELGNVVESLRWVASFPSFVAVPGPCEPEDLIDGIIFAANYLGSTQLLLKLLKLGLVLEVSSSTKKEREK

SEQ ID NO: 868425 - protein, 749 aa, Homo sapiens; identical to SEQ ID NO: 868418

SEQ ID NO: 868426 - protein, 749 aa, Homo sapiens; identical to SEQ ID NO: 868418

SEQ ID NO: 868427 - protein, 737 aa, Homo sapiens
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKNSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 868428 - protein, 129 aa, Homo sapiens
GSLQPLPLRFKQFSCLSLRVAGTTGMCHHAQLIFLFLVEMGFHHVGQAGLELVTSSDSPTLASQSTGITGMSHRAWQKSFFSSSEECEGRRARIQFSHFPTQYLERECLAGHWGVIGSGCPPSSSSFSF

SEQ ID NO: 868429 - protein, 118 aa, Homo sapiens
RRPAPRALPTMVNLGLSRVDDAVAAKHPGLGEYAACQSHAFMKGVFTFVTGTGMAFGLQMFIQRKFPYPLQWSLLVAVVAGSVVSYGVTRVESEKCNNLWLFLETGQLPKDRSTDQRS

SEQ ID NO: 868430 - protein, 88 aa, Homo sapiens
QCRCELPVLQTHHKPPPQRKHIRLAELLSLEQLPGDSFQLGHMSGGHPKVAGGRVRQEALQFQGCPGTENPGCHHNGLRFWGQSEWRL

SEQ ID NO: 868431 - protein, 151 aa, Homo sapiens
EAGGTLLLRGSGRPGGHRGGGTCPSAQGLTPPQPGCAQRRDRRGGEGRGQGIEPSPASATPGLGEYAACQSHAFMKGVFTFVTGTGMAFGLQMFIQRKFPYPLQWSLLVAVVAGSVVSYGVTRVESEKCNNLWLFLETGQLPKDRSTDQRS

SEQ ID NO: 868432 - protein, 90 aa, Homo sapiens
RRPAPRALPTMVNLGLSRVDDAVAAKHPGLGEYAACQSHAFMKGVFTFVTVAGSVVSYGVTRVESEKCNNLWLFLETGQLPKDRSTDQRS

SEQ ID NO: 868433 - protein, 185 aa, Homo sapiens
AQARSPSPANHGELGSVPGGRRRGCQAPGRLRPGVLRLGENAPSRPALTPQQGAPSHLPAGAGGLARWALAIPGYRLMGTSALCRHRHGLWLADVHSEEVSIPFAVEPPSGRGCRLCGQLRGDESGVGEMQQPLALPGDRAAPQRQEHRSEKLGELQQGHRGLGAGGVWNTAFMPPDPRPTLPTP

SEQ ID NO: 868434 - protein, 146 aa, Homo sapiens
RRPAPRALPTMVNLGLSRVDDAVAAKHPPGCAQRRDRRGGEGRGQGIEPSPASATPGLGEYAACQSHAFMKGVFTFVTGTGMAFGLQMFIQRKFPYPLQWSLLVAVVAGSVVSYGVTRVESEKCNNLWLFLETGQLPKDRSTDQRS

SEQ ID NO: 868435 - protein, 89 aa, Homo sapiens
RRPAPRALPTMVNLGLSRVDDAVAAKHPGLGEYAACQSHAFMKGVFTFVTGTGMAFGLQMFIQRKFPYPLQWSLLVAVGGYSRAPAWAL

SEQ ID NO: 868436 - protein, 219 aa, Homo sapiens
MLRSRRGTEQVPSPRFPVGLPRASTRPPAGGLHGGPLRNHEWAVPFPTQVVREKLRKYVFDRVNMHNLLIHLVRRRGQKLESMQLELDSLRSQPDASKEELRLLQIIRQLENNIEKTMIKIITSQNIHLLYLDLLDYLKTVSPAAREGRGSGAGIWEGRERPGAEPPRTRQGEGALPDHRLRRTPRHVENVFLNFIFGYSKKAYRGVYQNSSDFLARIK

SEQ ID NO: 868437 - protein, 303 aa, Homo sapiens
AQARSPSPANHGELGSVPGGRRRGCQAPGTGMAFGLQMFIQRKFPYPLQWSLLVAVVAGSVVSYGVTRVESEKCNNLWLFLETGQLPKDRSTEQCRALQIQGVKENMDQNKATLALLRSNIRRGAQDWALAKKVVREKLRKYVFDRVNMHNLLIHLVRRRGQKLESMQLELDSLRSQPDASKEELRLLQIIRQLENNIEKTMIKIITSQNIHLLYLDLLDYLKTVSPAAREGRGSGAGIWEGRERPGAEPPRTRQGEGALPDHRLRRTPRHVENVFLNFIFGYSKKAYRGVYQNSSDFLARIK

SEQ ID NO: 868438 - protein, 118 aa, Homo sapiens; identical to SEQ ID NO: 868429

SEQ ID NO: 868439 - protein, 118 aa, Homo sapiens; identical to SEQ ID NO: 868429

SEQ ID NO: 868440 - protein, 96 aa, Homo sapiens
AQARSPSPANHGELGSVPGGRRRGCQAPGTGMAFGLQMFIQRKFPYPLQWSLLVAVVAGSVVSYGVTRVESEKCNNLWLFLETGQLPKDRSTDQRS

SEQ ID NO: 868441 - protein, 285 aa, Homo sapiens
MRRHSETDVEEQTQELKTITQLQEQCRALQIQGVKENMDQNKATLALLRSNIRRGAQDWALAKKVVREKLRKYVFDRVNMHNLLIHLVRRRGQKLESMQLELDSLRSQPDASKEELRLLQIIRQLENNIEKTMIKIITSQNIHLLYLDLLDYLKTVLAGYPIELDKLQNLVVNYCSELSDMKIMSQDAMMITDEVHEEHEAKGRLLHRGARQGNGQQRKVSTDPRGTAEYAGEGGFLDRGRTDGGKAPRMDPGKRGGGKGGPGTPAKEETKAGPREEARPSEKNR

SEQ ID NO: 868442 - protein, 96 aa, Homo sapiens; identical to SEQ ID NO: 868440

SEQ ID NO: 868443 - protein, 90 aa, Homo sapiens; identical to SEQ ID NO: 868432

SEQ ID NO: 868444 - protein, 234 aa, Homo sapiens
MRRHSETDVEEQTQELKTITQLQEQCRALQIQGVKENMDQNKATLALLRSNIRRGAQDWALAKKVVREKLRKYVFDRVNMHNLLIHLVRRRGQKLESMQLELDSLRSQPDASKEELRLLQIIRQLENNIEKTMIKIITSQNIHLLYLDLLDYLKTVSPAAREGRGSGAGIWEGRERPGAEPPRTRQGEGALPDHRLRRTPRHVENVFLNFIFGYSKKAYRGVYQNSSDFLARIK

SEQ ID NO: 868445 - protein, 118 aa, Homo sapiens; identical to SEQ ID NO: 868429

SEQ ID NO: 868446 - protein, 854 aa, Homo sapiens
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 868447 - protein, 1051 aa, Homo sapiens
AGRRERRRGCRPVLGALSGAARPLVPQPSGRKRCRQRPGRALGHPHLPAPGRLPGRAVRRVGCWDRGDLEAEGRTGRPRRSTAAGSASDPARGAGSMADRARGAGLWTFRRRGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 868448 - protein, 834 aa, Homo sapiens
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 868449 - protein, 834 aa, Homo sapiens; identical to SEQ ID NO: 868448

SEQ ID NO: 868450 - protein, 834 aa, Homo sapiens; identical to SEQ ID NO: 868448

SEQ ID NO: 868451 - protein, 782 aa, Homo sapiens
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKVTPGPSPSRCPPPEAGLRAVWRPPLWSDFRTDAGFGVC

SEQ ID NO: 868452 - protein, 263 aa, Homo sapiens
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTVMIHFIRHQ

SEQ ID NO: 868453 - protein, 1051 aa, Homo sapiens; identical to SEQ ID NO: 868447

SEQ ID NO: 868454 - protein, 834 aa, Homo sapiens; identical to SEQ ID NO: 868448

SEQ ID NO: 868455 - protein, 834 aa, Homo sapiens; identical to SEQ ID NO: 868448

SEQ ID NO: 868456 - protein, 750 aa, Homo sapiens
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 868457 - protein, 653 aa, Homo sapiens
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTSTGRYFSSS

SEQ ID NO: 868458 - protein, 955 aa, Homo sapiens
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 868459 - protein, 237 aa, Homo sapiens
MLTLLGANKAAHSLSHSLITPTLLGSLAFKKMQFRLWSQRGLGWKGINAWHSSALPTLLPTCSQVYQTQDIHKAKTPITSPPPECNTNALSALGTQAIPRGSSRQQPQAYSPDPEPFLFLFVPNLTQSAHPCCTAPEGAPRQAWKAPCRQGNRTYLHPRSTHLHLHHHSAASVPSVAVSTAPRAILLLLIDFFGLGHLDLTLKVKRTVVRPVGQTQGSDCPNTFTATNIKWWIRSIC

SEQ ID NO: 868460 - protein, 450 aa, Homo sapiens
MAADQRPKADTLALRQRLISSSCRLFFPEDPVKIVRAQGQYMYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVAPLPDTYRGPYREDHPNPAMAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 868461 - protein, 409 aa, Homo sapiens
MYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVAPLPDTYRGPYREDHPNPAMAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 868462 - protein, 264 aa, Homo sapiens
MAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 868463 - protein, 357 aa, Homo sapiens
MAADQRPKADTLALRQRLIRSEANDLALRLARHYTGHQDVVVLDHAYHGHLSSLIDISPYKFRNLDGQKEWVHVAPLPDTYRGPYREDHPNPAMAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 868464 - protein, 397 aa, Homo sapiens
MYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVAPLPDTYRGPYREDHPNPAMAYANEVKRVVSSAQEKGRRLQPSSLSLCPVWEGRSFPLLATSPKWQNEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 868465 - protein, 464 aa, Homo sapiens
MAADQRPKADTLALRQRLISHLFSGSGRLTRTHAEMSKEATEAENAFRNNPKFQRLVTPSASCFATTCGVERQVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVAPLPDTYRGPYREDHPNPAMAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 868466 - protein, 420 aa, Homo sapiens
MAADQRPKADTLALRQRLISSSCRLFFPEDPVKIVRAQGQYMYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVVCTAQLNNQIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 868467 - protein, 175 aa, Homo sapiens
MGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 868468 - protein, 399 aa, Homo sapiens
MAADQRPKADTLALRQRLISSSCRLFFPEDPVKIVRAQGQYMYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVAPLPDTYRGPYREDHPNPAMAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRHGREGEKL

SEQ ID NO: 868469 - protein, 109 aa, Homo sapiens
MVPSTLEEPKEVHEGKAEAVSCWEASRAHHLGPSPPSGESCLYPKSIGKLSEALIRKRCLKGNGVQEWTLLGASSVARCKVMVAHTRIGSGDKQAGDYSVSGREHSNKS

SEQ ID NO: 868470 - protein, 450 aa, Homo sapiens; identical to SEQ ID NO: 868460

SEQ ID NO: 868471 - protein, 237 aa, Homo sapiens; identical to SEQ ID NO: 868459

SEQ ID NO: 868472 - protein, 102 aa, Homo sapiens
MPCDGGGPLPVGHCHPLVVQAAHEQNQVLNTNSRYLHDNIVDYAQRLSETLPEQLCVFYFLNSGGVGLFIGVDLIKDEATRTPATEEAAYLVSRHGREGEKL

SEQ ID NO: 868473 - protein, 118 aa, Homo sapiens
MYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDQYSATHSPTVPRSLAHRLLGDP

SEQ ID NO: 868474 - protein, 132 aa, Homo sapiens
NHSKHTTTWILNNVLLSDFWVNNKIKAEIKKLFGTNENKETMYQNLWEATKAVLRGKFIALNAHIIKEHVTHIHPRSSCLVKGITTYICSRQKPHAPQSCINPASSISMMPLNSLHLSISMATTCLEGMLLS

SEQ ID NO: 868475 - protein, 175 aa, Homo sapiens; identical to SEQ ID NO: 868467

SEQ ID NO: 868476 - protein, 409 aa, Homo sapiens; identical to SEQ ID NO: 868461

SEQ ID NO: 868477 - protein, 423 aa, Homo sapiens
MYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVVCTAQLNNSDMLSSLGGGIITLVAMWRMDWKRHSVRRPLQESKEETGKSAGEQIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 868478 - protein, 175 aa, Homo sapiens; identical to SEQ ID NO: 868467

SEQ ID NO: 868479 - protein, 322 aa, Homo sapiens
MAADQRPKADTLALRQRLISSSCRLFFPEDPVKIVRAQGQYMYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVAPLPDTYRGPYREDHPNPAMAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTGCWALHWCGSDQR

SEQ ID NO: 868480 - protein, 109 aa, Homo sapiens; identical to SEQ ID NO: 868469

SEQ ID NO: 868481 - protein, 109 aa, Homo sapiens; identical to SEQ ID NO: 868469

SEQ ID NO: 868482 - protein, 450 aa, Homo sapiens; identical to SEQ ID NO: 868460

SEQ ID NO: 868483 - protein, 37 aa, Homo sapiens
MSKEATEAENCFQKQSEVSATCYPICFLLCNHLWSGE

SEQ ID NO: 868484 - protein, 131 aa, Homo sapiens
MAADQRPKADTLALRQRLISSSCRLFFPEDPVKIVRAQGQYMYDEQGAEYIDCISNVAHVGHCHPLVVQAAHEQNQVLNTNSRYLHDNIVDYAQRLSETLPEQLCVFYFLNSGDGPTPYPARRNAAVMKLP

SEQ ID NO: 868485 - protein, 102 aa, Homo sapiens
ARASDMFFVPGSVWGQPSVLRCGAGRPECLGEGAAPGSCHQCRQLPDAAPRAAKNQTSHRRGCQVRLWGQQSPPTCQGPVWYHFLHLLTTWDGGVMSALKRN

SEQ ID NO: 868486 - protein, 143 aa, Homo sapiens [sequence omitted]

SEQ ID NO: 868487 - protein, 306 aa, Homo sapiens
MGERLLESKKDHQHGEILTQVPDDMLKKKTPRVKSCGEVSVGHASLNRHHRADTGHKPYEYQEYGQKPYKCTYCKKAFSDLPYFRTHEWAHTGGKPYDCEECGKSFISRSSIRRHRIMHSGDGPYKCNFCGKALMCLSLYLIHKRTHTGEKPYECKQCGKAFSHSGSLRIHERTHTGEKPYECSECGKAFHSSTCLHAHKITHTGEKPYECKQCGKAFVSFNSVRYHERTHTGEKPYECKQCGKAFRSASHLRTHGRTHTGEKPYECKQCGKAFGCASSVKIHERTHTGEKPCSSNTSKGQGEKIA

SEQ ID NO: 868488 - protein, 238 aa, Homo sapiens
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRRPASAALATRRCWCCRLPRALVPPGPAWTRKGEASSWTRTRKSSRCCRKIARDGRPPDSPAPFGSCRKPWRLRREVARQPSCPAH

SEQ ID NO: 868489 - protein, 104 aa, Homo sapiens
RLQALEAGREDWGLSELGKKAGVPASRALATPPKLHTCEKCSTSIANQAVRIQEGRYRHPGCYTCADCGLNLKMRGHFWVGDELYCEKHARQRYSAPATLSSRA

SEQ ID NO: 868490 - protein, 739 aa, Homo sapiens
ESGRRQRERWRLPAFPPSRAWAPSRTGERQPGERAHLRLSARPALPGAGLLSAPLSARNPGLVRGPAPWSLASAGAPPRAALSPAGALLLQPPARRVLCPRSEGGSRTGRAGPSGWAPPRGARSAESTDRLKGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERDGAGEGLARGCIVPGVTSTYRRIPDAAHGCSSWERGDKFRGVGREALFLKLASRDSGVEMAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKRDISHWDKVKVLLNRICRRSHHHPEPPAPPDGSDPRIESRDLPERPQCRPHRKTFMPSLVVKKQRAKNLSVG

SEQ ID NO: 868491 - protein, 329 aa, Homo sapiens
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIAWGWRGPGTGLHSAWSHQHLQTDPRRCPRVLILGER

SEQ ID NO: 868492 - protein, 346 aa, Homo sapiens
TRGGSMALRSPERGLPGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIAWGWRGPGTGLHSAWSHQHLQTDPRRCPRVLILGER

SEQ ID NO: 868493 - protein, 411 aa, Homo sapiens
ESGRRQRERWRLPAFPPSRAWAPSRTGERQPGERAHLRLSARPALPGAGLLSAPLSARNPGLVRGPAPWSLASAGAPPRAALSPAGALLLQPPARRVLCPRSEGGSRTGRAGPSGWAPPRGARSAESTDRLKGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGTRLCASRRAGTATPAATPVPTVG

SEQ ID NO: 868494 - protein, 462 aa, Homo sapiens
ESGRRQRERWRLPAFPPSRAWAPSRTGERQPGERAHLRLSARPALPGAGLLSAPLSARNPGLVRGPAPWSLASAGAPPRAALSPAGALLLQPPARRVLCPRSEGGSRTGRAGPSGWAPPRGARSAESTDRLKGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIAWGWRGPGTGLHSAWSHQHLQTDPRRCPRVLILGER

SEQ ID NO: 868495 - protein, 462 aa, Homo sapiens; identical to SEQ ID NO: 868494

SEQ ID NO: 868496 - protein, 462 aa, Homo sapiens; identical to SEQ ID NO: 868494

SEQ ID NO: 868497 - protein, 444 aa, Homo sapiens
ESGRRQRERWRLPAFPPSRAWAPSRTGERQPGERAHLRLSARPALPGAGLLSAPLSARNPGLVRGPAPWSLASAGAPPRAALSPAGALLLQPPARRVLCPRSEGGSRTGRAGPSGWAPPRGARSAESTDRLKGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPSPCQASPLQDWHCTSLRWPLPLINLCVRGSK

SEQ ID NO: 868498 - protein, 485 aa, Homo sapiens
ESGRRQRERWRLPAFPPSRAWAPSRTGERQPGERAHLRLSARPALPGAGLLSAPLSARNPGLVRGPAPWSLASAGAPPRAALSPAGALLLQPPARRVLCPRSEGGSRTGRAGPSGWAPPRGARSAESTDRLKGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWVGDELYCEKHARQRYSAPATLSSRA

SEQ ID NO: 868499 - protein, 462 aa, Homo sapiens; identical to SEQ ID NO: 868494

SEQ ID NO: 868500 - protein, 365 aa, Homo sapiens
MMGRRRAFAVDGRDGAGEGLARGCIVPGVTSTYRRIPDAAHGCSSWERGDKFRGVGREALFLKLASRDSGVEMAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKRDISHWDKVKVLLNRICRRSHHHPEPPAPPDGSDPRIESRDLPERPQCRPHRKTFMPSLVVKKQRAKNLSVG

SEQ ID NO: 868501 - protein, 449 aa, Homo sapiens
GKSGRRPSKGLMDVACQGFAYHTAQSTGSLSLTTVAKGIPSTHLPDSWGHIRAARGCPVTALPHCSGTLLPGAVLPAFRNAGGVGGGLPSLTLTLHADGAGEGLARGCIVPGVTSTYRRIPDAAHGCSSWERGDKFRGVGREALFLKLASRDSGVEMAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKRDISHWDKVKVLLNRICRRSHHHPEPPAPPDGSDPRIESRDLPERPQCRPHRKTFMPSLVVKKQRAKNLSVG

SEQ ID NO: 868502 - protein, 366 aa, Homo sapiens
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWEDACAMEGMRLSLEALEGMVEGAKRRDRRKTRRPIQPSW

SEQ ID NO: 868503 - protein, 462 aa, Homo sapiens; identical to SEQ ID NO: 868494

SEQ ID NO: 868504 - protein, 485 aa, Homo sapiens; identical to SEQ ID NO: 868498

SEQ ID NO: 868505 - protein, 459 aa, Homo sapiens
ESGRRQRERWRLPAFPPSRAWAPSRTGERQPGERAHLRLSARPALPGAGLLSAPLSARNPGLVRGPAPWSLASAGAPPRAALSPAGALLLQPPARRVLCPRSEGGSRTGRAGPSGWAPPRGARSAESTDRLKGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRCPTQAALEADSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWVGDELYCEKHARQRYSAPATLSSRA

SEQ ID NO: 868506 - protein, 78 aa, Homo sapiens
MENTPKMQPPLLSMQALCLTAAGNTVTWRSHSPGLSEDGHMLCILPLHGLPQLSPQISLHKPSLPLYTSSPSVVPRRT

SEQ ID NO: 868507 - protein, 117 aa, Homo sapiens
KLAAAAPISPWTMAATIQAMERKIESQAAHLLSLEGQTGMAEKKLADCEKTAVEFGNQLEGKWAVLGTLLQEYGLLQRRLENVENLLHNRNFWILRLPPGSKGESPKVPMTFDDVAV

SEQ ID NO: 868508 - protein, 117 aa, Homo sapiens; identical to SEQ ID NO: 868507

SEQ ID NO: 868509 - protein, 117 aa, Homo sapiens; identical to SEQ ID NO: 868507

SEQ ID NO: 868510 - protein, 117 aa, Homo sapiens; identical to SEQ ID NO: 868507

SEQ ID NO: 868511 - protein, 117 aa, Homo sapiens; identical to SEQ ID NO: 868507

SEQ ID NO: 868512 - protein, 117 aa, Homo sapiens; identical to SEQ ID NO: 868507

SEQ ID NO: 868513 - protein, 117 aa, Homo sapiens; identical to SEQ ID NO: 868507

SEQ ID NO: 868514 - protein, 117 aa, Homo sapiens; identical to SEQ ID NO: 868507

SEQ ID NO: 868515 - protein, 209 aa, Homo sapiens
NCGRRRAGAVREQRRQRQGRAGAACGEHREAGPAWGRAQQRRRLYLGRGGQRRAMEEAAAAPISPWTMAATIQAMERKIESQAAHLLSLEGQTGMAEKKLADCEKTAVEFGNQLEGKWAVLGTLLQEYGLLQRRLENVENLLHNRNFWILRLPPGSKGESPKTTPSPSPRSSPRLNKGRSPATGAALTPRFQMFLWTPVQMQKLRPSRD

SEQ ID NO: 868516 - protein, 117 aa, Homo sapiens; identical to SEQ ID NO: 868507

SEQ ID NO: 868517 - protein, 117 aa, Homo sapiens; identical to SEQ ID NO: 868507

SEQ ID NO: 868518 - protein, 117 aa, Homo sapiens; identical to SEQ ID NO: 868507

SEQ ID NO: 868519 - protein, 74 aa, Homo sapiens
KLAAAAPISPWTMAATIQAMERKIESQAAHLLSLEGQTGMAEKKLADCEKTAVEFGNQLEGKWAVLGTLNALAQ

SEQ ID NO: 868520 - protein, 366 aa, Homo sapiens
RRRQRPRPPPRTLLFPGVRRALPPSHLKRTIAGKSFAFCDSLKRSSKSGEKFPAERATALDPGVAAGGMGLQAGAGRPGAGALRGRAGASCCRCRCRCRCRCSCCCCYARAPAGLRLQGEAEAPTLYWKGPWGRCMGDECGPGGIQTRAVWCAHVEGWTTLHTNCKQAERPNNQQNCFKVCDWHKELYDWRLGPWNQCQPVISKSLEKPLECIKGEEGIQVREIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELI

SEQ ID NO: 868521 - protein, 269 aa, Homo sapiens
MTTIRLTARGAPAAAQNQFLMYLAVIGKASGESPWGRCMGDECGPGGIQTRAVWCAHVEGWTTLHTNCKQAERPNNQQNCFKVCDWHKELYDWRLGPWNQCQPVISKSLEKPLECIKGEEGIQVREIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELI

SEQ ID NO: 868522 - protein, 104 aa, Homo sapiens
MTTIRLTARGAPAAAQNQFLMYLAVIGKASEKVHGADVWEMNVVPEASKRGLCGVLMWRDGLHCILTVSRPRDPITSSSRGTYQDRVHIHVKGQPPVQEHLGVI

SEQ ID NO: 868523 - protein, 114 aa, Homo sapiens
PGAVCVCVSVYLARRYGPHQTGAPQSRLESGSVTQAGVQSRESQLTATYASQVKRFSCLGLPRNWNHRRAPLRPRIFTFNCTVKHRLLSQTAWSELWCHHLVSSGLNVLTEWSS

SEQ ID NO: 868524 - protein, 133 aa, Homo sapiens
MNHTVQTFFSPVNSGQPPNYEMLKEEHEVAVLGAPHNPAPPTSTVIHIRSETSVPDHVVWSLFNTLFMNPCCLGFIAFAYSVKSRDRKMVGDVTGAQAYASTAKCLNIWALILGILMTILLIVIPVLIFQAHR

SEQ ID NO: 868525 - protein, 133 aa, Homo sapiens; identical to SEQ ID NO: 868524

SEQ ID NO: 868526 - protein, 133 aa, Homo sapiens; identical to SEQ ID NO: 868524

SEQ ID NO: 868527 - protein, 129 aa, Homo sapiens
ASGSCQVLLTFKHVQFWGPFLCFWIQMVVPKGALSLLIKWEAKKQVSFCAEIPGVGRLCCRRHGATASHRPRAVCLCLMNVLHGLCGHFSLRTLSCALADGRFAFGHETEHSAGTITLFLETYLGNKNL

SEQ ID NO: 868528 - protein, 867 aa, Homo sapiens
LKVRGKRVNARLQRAATYAWCLLSPAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFLLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 868529 - protein, 867 aa, Homo sapiens; identical to SEQ ID NO: 868528

SEQ ID NO: 868530 - protein, 815 aa, Homo sapiens
MEASKVLDKSKAAESSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFLLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 868531 - protein, 907 aa, Homo sapiens
LKVRGKRVNARLQRAATYAWCLLSPAIGDQSRPLCSRKGLSGGGSGGGPPWRARSQPGHCGSLKPSSELPVSPVPGGCLQLCLASQPVDHCRGIGEYLPGESRDKKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFLLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 868532 - protein, 867 aa, Homo sapiens; identical to SEQ ID NO: 868528

SEQ ID NO: 868533 - protein, 867 aa, Homo sapiens; identical to SEQ ID NO: 868528

SEQ ID NO: 868534 - protein, 874 aa, Homo sapiens
LKVRGKRVNARLQRAATYAWCLLSPAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQDRVSLQQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFLLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 868535 - protein, 771 aa, Homo sapiens
LKVRGKRVNARLQRAATYAWCLLSPAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFLLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 868536 - protein, 346 aa, Homo sapiens
MGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFLLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 868537 - protein, 754 aa, Homo sapiens
LKVRGKRVNARLQRAATYAWCLLSPAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFLLQCAMEENCLSASAAQTDPTTGYRRLLRFSSQIHNNGQSDWGKGSGPIHLNEIQCTGNEKSIIDCKFNAESQGCNHEEDAGVRCNTPPWAC

SEQ ID NO: 868538 - protein, 533 aa, Homo sapiens
LKVRGKRVNARLQRAATYAWCLLSPAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKVMGLDT

SEQ ID NO: 868539 - protein, 444 aa, Homo sapiens
LKVRGKRVNARLQRAATYAWCLLSPAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEAGVQWHDLGSLQPPAPGFTRFSCLGLPSS

SEQ ID NO: 868540 - protein, 855 aa, Homo sapiens [sequence omitted]

SEQ ID NO: 868541 - protein, 774 aa, Homo sapiens [sequence omitted]

SEQ ID NO: 868542 - protein, 822 aa, Homo sapiens
LKVRGKRVNARLQRAATYAWCLLSPAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFLLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVPSAKRRKKSLSTSAGS

SEQ ID NO: 868543 - protein, 867 aa, Homo sapiens; identical to SEQ ID NO: 868528

SEQ ID NO: 868544 - protein, 867 aa, Homo sapiens; identical to SEQ ID NO: 868528

SEQ ID NO: 868545 - protein, 520 aa, Homo sapiens
LPHPNTPTTHTHTHTHTHTHIHTSSIVAAPRLSAWPGNRVAGKGGGGDSGHPLNVLSVCTQQDRVSLQQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFLLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 868546 - protein, 668 aa, Homo sapiens
LKVRGKRVNARLQRAATYAWCLLSPAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSESESSSPPSPPGSRGDQSPTSYSSRDSEALP

SEQ ID NO: 868547 - protein, 381 aa, Homo sapiens
MPSGCRCLHLVCLLCILGAPGQPVRADDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGPWNSSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 868548 - protein, 381 aa, Homo sapiens; identical to SEQ ID NO: 868547

SEQ ID NO: 868549 - protein, 342 aa, Homo sapiens
MPSGCRCLHLVCLLCILGAPGQPVRADDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGPCEQLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 868550 - protein, 350 aa, Homo sapiens
MPSGCRCLHLVCLLCILGAPGQPVRADDCSSHCDLAHGCCAPDGSCRCDPGWEGLHCERCVRMPGCQHGTCHQPWQCICHSGWAGKFCDKGFHGRDCERKAGPWNSSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 868551 - protein, 102 aa, Homo sapiens
STWEFLTGILRDLSSETSITYYSLHSLLHFTLLSHLRIHDPLIQAQAEELTHLRQKIQEGRGVCYLFTQHVKNTVKSFEGLLRNTGIAYYQRQRFCEQMVQG

SEQ ID NO: 868552 - protein, 1037 aa, Homo sapiens [sequence omitted]

SEQ ID NO: 868553 - protein, 444 aa, Homo sapiens
MILKGREEWVSRNFFFSFFHSPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMFYSEKLCGVTELQCLALAPQHLAAECHGDGTPEMAPVPVPWECVGAQPPLTPEWVQSQCRGRCMAAQPPLTIRVPQEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIR

SEQ ID NO: 868554 - protein, 1128 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMYTLRHHVKIGGLHVSFTVRNCVECRNCSALLSRPSTWLQSVTEMGPLRWLQSQCRGQCVGAQPPLTPEWVQSQCRGRCMAAQPPLTIRVPQEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIR

SEQ ID NO: 868555 - protein, 602 aa, Homo sapiens [sequence omitted]

SEQ ID NO: 868556 - protein, 992 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKAGPQRAALCCQPRQAPGRER

SEQ ID NO: 868557 - protein, 497 aa, Homo sapiens
NYSSVDRCSISQRCSCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIR

SEQ ID NO: 868558 - protein, 736 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTTSSWP

SEQ ID NO: 868559 - protein, 708 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQVLLFSSLCLAVSDRYLGTGKSTHGLAILGPENPKIAKDPSWIIR

SEQ ID NO: 868560 - protein, 644 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTGHCERYAFPSWRYPCSVLRPAHQWHGVFPGLLQPEHTPRGAEALCAPLLQRPHQVRVATYPCVSY

SEQ ID NO: 868561 - protein, 596 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTGHCERYAFPRSRVPWGN

SEQ ID NO: 868562 - protein, 1161 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSVSDLSTILFLFYNRHFVLLLSLTGILIFLCEIDYFKWVRVYNYVICWLFPKHYFSLLLFILLEQNRAKVSFFVSPSKELHDFCYKQSSVVYLNTETRILYQVWAVGGGCTVVPAALWMWKSSFQYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIR

SEQ ID NO: 868563 - protein, 1113 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMFYSEKLCGVTELQCLALAPQHLAAECHGDGTPEMAPVPVPWECVGAQPPLTPEWVQSQCRGRCMAAQPPLTNRVPQEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIR

SEQ ID NO: 868564 - protein, 1021 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGILSITVRISTHSLTDDVAVFQVPGMHGQEHQLLVPPSLLVIRFPRLTP

SEQ ID NO: 868565 - protein, 1021 aa, Homo sapiens; identical to SEQ ID NO: 868564

SEQ ID NO: 868566 - protein, 181 aa, Homo sapiens
GRVLIGRGYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIR

SEQ ID NO: 868567 - protein, 664 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTVSVSFLLPDITDTFEAFTLSLLSSLLTSGPNSPFYKALIESGLGTDFSPDVGYNGYTREAYFSVGLQGIVEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDLSDPDEFK

SEQ ID NO: 868568 - protein, 67 aa, Homo sapiens
LPGLVQEGEPFSEEATLFTKELVLQRELLCLLSDSCFICCLIFVGLTFPICSCMSIFLYLMFLKRQI

SEQ ID NO: 868569 - protein, 278 aa, Homo sapiens
RLFSVVAFKCPCSTENMTYGLVFLFAPAWVLLILGFFLNNRSWRLFTGCCVNPRKIFPRGHSCRFFYVLGQITLSSLVAPVMWLSVALLNGTFYECAMSGTRSSGLLELICKGKPKECWEELHKVSCGKTSMLPTVNEELKLSLQAQSQILGWCLICSASFFSLLTTCYARCRSKVSYLQLSFWKTYAQKEKEQLENTFLDYANKLSERNLKCFFENKRPDPFPMPTFAAWEAASELHSFHQSQQHYSTLHRVVDNGLQLSPEDDETTMVLVGTAHNM

SEQ ID NO: 868570 - protein, 278 aa, Homo sapiens; identical to SEQ ID NO: 868569

SEQ ID NO: 868571 - protein, 34 aa, Homo sapiens
MSEELLSLLPPGLCQMCPGLHLQRRLRQVQLLPM

SEQ ID NO: 868572 - protein, 468 aa, Homo sapiens
MAKRNAEKELTDRNWDQEDEAEEVGTFSMASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 868573 - protein, 168 aa, Homo sapiens
SQPRAGFQGAGRMRRVRGPAGGRRCYCRKRRRACAVAERGRFFPPFFSNGFGGRFELQNGRPECVRRGSPSCLWLNRRSRLPAEHSVRSPPRDMVFESLGLPSTKSSEFRSAAPEAAERAQPGDPCGLQTPAPLRPGFRRNQDPASAAAAAEEVRKHGQKKCREGTDR

SEQ ID NO: 868574 - protein, 440 aa, Homo sapiens
MASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 868575 - protein, 218 aa, Homo sapiens
MEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 868576 - protein, 157 aa, Homo sapiens
ARYPLPSLTILPLSREGDSGECRGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 868577 - protein, 118 aa, Homo sapiens
MAKRNAEKELTDRNWDQEDEAEEVGTFSMASEEVLKNRAIKKAKRRNVGFEVSAPLQLLLLNTHLISGLHSNPSAGSNDINKCFLKILILCCRSWEIEKNKKRQVWTLKRAYPVEEIR

SEQ ID NO: 868578 - protein, 468 aa, Homo sapiens; identical to SEQ ID NO: 868572

SEQ ID NO: 868579 - protein, 440 aa, Homo sapiens; identical to SEQ ID NO: 868574

SEQ ID NO: 868580 - protein, 247 aa, Homo sapiens [sequence omitted]

SEQ ID NO: 868581 - protein, 215 aa, Homo sapiens
KRVSEYYYLDSNDKKKEEHHYKAVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 868582 - protein, 1066 aa, Homo sapiens
MVVQAAVAPNRSQRLLLKIPYGSLRRRSVERMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGSYNDSCFLDSSLYPELADVQWYGQEKAKPGTLV

SEQ ID NO: 868583 - protein, 741 aa, Homo sapiens
MAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGSYNDSCFLDSSLYPELADVQWYGQEKAKPGTLV

SEQ ID NO: 868584 - protein, 874 aa, Homo sapiens
RKLSSALHADGYRSLLSARSSRSSPLTRRLPCWVPLPGLHLSSLSWKGKVCQAGDCHDQTNKGRPKAENLKRTCFVPIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGSYNDSCFLDSSLYPELADVQWYGQEKAKPGTLV

SEQ ID NO: 868585 - protein, 1066 aa, Homo sapiens; identical to SEQ ID NO: 868582

SEQ ID NO: 868586 - protein, 437 aa, Homo sapiens
MVVQAAVAPNRSQRLLLKIPYGSLRRRSVERMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAVSLS

SEQ ID NO: 868587 - protein, 1039 aa, Homo sapiens
MAVQLVPDSALGLLMMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGEATENSPILDGSESPPHQSTDE

SEQ ID NO: 868588 - protein, 450 aa, Homo sapiens
MVVQAAVAPNRSQRLLLKIPYGSLRRRSVERMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGRQRPAGGTPPEHGWDPRGDPGRWGELQLGRLQGKLLQSWLCFPDQGWDPNANLRKLLPGIK

SEQ ID NO: 868589 - protein, 933 aa, Homo sapiens
RYHKALYCVYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGSYNDSCFLDSSLYPELADVQWYGQEKAKPGTLV

SEQ ID NO: 868590 - protein, 664 aa, Homo sapiens
MLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGSYNDSCFLDSSLYPELADVQWYGQEKAKPGTLV

SEQ ID NO: 868591 - protein, 1066 aa, Homo sapiens; identical to SEQ ID NO: 868582

SEQ ID NO: 868592 - protein, 155 aa, Homo sapiens
MVVQAAVAPNRSQRLLLKIPYGSLRRRSVERMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKMESHSVAQAVV

SEQ ID NO: 868593 - protein, 505 aa, Homo sapiens
EARPMGTRAARPAGLPCGAENPARRRLALGARQQIHSWSPRTPSTRLTAPAGPARGVARPAMAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 868594 - protein, 104 aa, Homo sapiens
MPSPTASAKTQTSTCIPSSLPWGRSSLWRCVEVSVERSWGIGGSQHRGVGEDAHDVVSVGKTLGLGWLGLLPFWKFWKATGNRWGLPRRESPSSLESSVSKPLL

SEQ ID NO: 868595 - protein, 505 aa, Homo sapiens; identical to SEQ ID NO: 868593

SEQ ID NO: 868596 - protein, 505 aa, Homo sapiens; identical to SEQ ID NO: 868593

SEQ ID NO: 868597 - protein, 493 aa, Homo sapiens
EARPMGTRAARPAGLPCGAENPARRRLALGARQQIHSWSPRTPSTRLTAPAGPARGVARPAMAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVEVRGGISEKVGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 868598 - protein, 360 aa, Homo sapiens
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 868599 - protein, 432 aa, Homo sapiens
EKFSKSALDPGSPSGFTSHFNLGTAFWRAGGWPLVRTLPESRGLAPSPFIFSRHLQDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 868600 - protein, 213 aa, Homo sapiens
AGLYAEVKDIGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 868601 - protein, 505 aa, Homo sapiens; identical to SEQ ID NO: 868593

SEQ ID NO: 868602 - protein, 378 aa, Homo sapiens
EARPMGTRAARPAGLPCGAENPARRRLALGARQQIHSWSPRTPSTRLTAPAGPARGVARPAMAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWISKQEYDEAGPSIVHRKCF

SEQ ID NO: 868603 - protein, 335 aa, Homo sapiens
EARPMGTRAARPAGLPCGAENPARRRLALGARQQIHSWSPRTPSTRLTAPAGPARGVARPAMAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGTEEKYTCRKRLAKGPIKQMVPNSS

SEQ ID NO: 868604 - protein, 122 aa, Homo sapiens
MSVLRHVGIGSDAPPMERFVNTKTWKVRGLSTKRHGRLGLSTQRHGRLEVCQHKDTGRMGCRRFRCFPFGHILLSWRTRFKTAWVGKLEASWMQWLMPVIPTLLGGPGRRITWAQEVKPAAS

SEQ ID NO: 868605 - protein, 505 aa, Homo sapiens; identical to SEQ ID NO: 868593

SEQ ID NO: 868606 - protein, 471 aa, Homo sapiens
MKHNYSGAIHKHLSLDRARAKPLPARVRHCGPTVREDAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 868607 - protein, 419 aa, Homo sapiens
MKRRERGLEKWSLGSGDGGQQHAHTNKGSRLPAVHSICSPEPQDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 868608 - protein, 505 aa, Homo sapiens; identical to SEQ ID NO: 868593

SEQ ID NO: 868609 - protein, 135 aa, Homo sapiens
EARPMGTRAARPAGLPCGAENPARRRLALGARQQIHSWSPRTPSTRLTAPAGPARGVARPAMAPDPVAAETAAQGPTPRYFTWDEVAQRSGCEERWLVIDRKVYNITLTPASPSNPQPLLPGGRITTLPLQQHLL

SEQ ID NO: 868610 - protein, 252 aa, Homo sapiens
GEQRRGVTQERQGTVAACGACYWLLGLMAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868611 - protein, 100 aa, Homo sapiens
HLEDYADRLGASLQQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868612 - protein, 161 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTWRQCYRARASHQEVSSSFRS

SEQ ID NO: 868613 - protein, 168 aa, Homo sapiens
MAVRASFENNCEIGCFAKLTNTYCLVAIGGSENFYSVFEGELSDTIPVVHASIAGCRIIGRMCVDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868614 - protein, 149 aa, Homo sapiens [sequence omitted]

SEQ ID NO: 868615 - protein, 252 aa, Homo sapiens; identical to SEQ ID NO: 868610

SEQ ID NO: 868616 - protein, 225 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868617 - protein, 225 aa, Homo sapiens; identical to SEQ ID NO: 868616

SEQ ID NO: 868618 - protein, 225 aa, Homo sapiens; identical to SEQ ID NO: 868616

SEQ ID NO: 868619 - protein, 225 aa, Homo sapiens; identical to SEQ ID NO: 868616

SEQ ID NO: 868620 - protein, 225 aa, Homo sapiens; identical to SEQ ID NO: 868616

SEQ ID NO: 868621 - protein, 235 aa, Homo sapiens
RGECYWLLGLMAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868622 - protein, 225 aa, Homo sapiens; identical to SEQ ID NO: 868616

SEQ ID NO: 868623 - protein, 225 aa, Homo sapiens; identical to SEQ ID NO: 868616

SEQ ID NO: 868624 - protein, 225 aa, Homo sapiens; identical to SEQ ID NO: 868616

SEQ ID NO: 868625 - protein, 225 aa, Homo sapiens; identical to SEQ ID NO: 868616

SEQ ID NO: 868626 - protein, 225 aa, Homo sapiens; identical to SEQ ID NO: 868616

SEQ ID NO: 868627 - protein, 225 aa, Homo sapiens; identical to SEQ ID NO: 868616

SEQ ID NO: 868628 - protein, 164 aa, Homo sapiens
MCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868629 - protein, 156 aa, Homo sapiens
GEQRRGVTQERQGTVAACGACYWLLGLMAVRASFENNCEIGCFAKLTNTYCLVAIGGSENFYRCGGSPGAYGGGEACAGVKSSGSGRVPAPLPRHHRVHVPTVCSRASSPIPSPWCTRLSPAAASSGACVWTGRQKKFWQMCSRWKSSDRQWPTRC

SEQ ID NO: 868630 - protein, 88 aa, Homo sapiens
GEQRRGVTQERQGTVAACGACYWLLGLMAVRASFENNCEIGCFAKLTNTYCLVAIGGSENFYRTGRQKKFWQMCSRWKSSDRQWPTRC

SEQ ID NO: 868631 - protein, 168 aa, Homo sapiens; identical to SEQ ID NO: 868613

SEQ ID NO: 868632 - protein, 168 aa, Homo sapiens; identical to SEQ ID NO: 868613

SEQ ID NO: 868633 - protein, 134 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDTNVQVPARVYHV

SEQ ID NO: 868634 - protein, 194 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868635 - protein, 117 aa, Homo sapiens
MSNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868636 - protein, 225 aa, Homo sapiens; identical to SEQ ID NO: 868616

SEQ ID NO: 868637 - protein, 285 aa, Homo sapiens
MEGGVGSLPNLAPLGQFHVVGTVKHSGATGTTPKLETALIESGAEPRAEIRHEGYWLLGLMAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868638 - protein, 225 aa, Homo sapiens; identical to SEQ ID NO: 868616

SEQ ID NO: 868639 - protein, 133 aa, Homo sapiens
VTLRIQSPRQGACYWLLGLMAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERSLSCDWEILKSDPS

SEQ ID NO: 868640 - protein, 225 aa, Homo sapiens; identical to SEQ ID NO: 868616

SEQ ID NO: 868641 - protein, 225 aa, Homo sapiens; identical to SEQ ID NO: 868616

SEQ ID NO: 868642 - protein, 225 aa, Homo sapiens; identical to SEQ ID NO: 868616

SEQ ID NO: 868643 - protein, 244 aa, Homo sapiens
VTLRIQSPRQGACYWLLGLMAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868644 - protein, 225 aa, Homo sapiens; identical to SEQ ID NO: 868616

SEQ ID NO: 868645 - protein, 285 aa, Homo sapiens; identical to SEQ ID NO: 868637

SEQ ID NO: 868646 - protein, 225 aa, Homo sapiens; identical to SEQ ID NO: 868616

SEQ ID NO: 868647 - protein, 225 aa, Homo sapiens; identical to SEQ ID NO: 868616

SEQ ID NO: 868648 - protein, 225 aa, Homo sapiens; identical to SEQ ID NO: 868616

SEQ ID NO: 868649 - protein, 187 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRVRQPNLTQESQGHPSQWLATVLSQQAAIRGLSCGFSIWALEFQVLIGIVITEALSSVRKKLGRV

SEQ ID NO: 868650 - protein, 147 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLSGRPGASRKLLCLQQSGRAGASQDFN

SEQ ID NO: 868651 - protein, 194 aa, Homo sapiens; identical to SEQ ID NO: 868634

SEQ ID NO: 868652 - protein, 239 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCEGLGTQPFSTCAYRLDLSLLQKPALLCWLAGPVAAG

SEQ ID NO: 868653 - protein, 246 aa, Homo sapiens
WLVEAGGEIGTEARAGILEGLMAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLEHNQHRAVSGGECLQAE

SEQ ID NO: 868654 - protein, 194 aa, Homo sapiens; identical to SEQ ID NO: 868634

SEQ ID NO: 868655 - protein, 108 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERSLSCDWGS

SEQ ID NO: 868656 - protein, 106 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDNLYRMLAGRWQRAHWD

SEQ ID NO: 868657 - protein, 421 aa, Homo sapiens
IPFSVSWGVLLLAGLCCLVPSSLVEDPQEDAAQKTDTSHHDQGDWEDLACQKISYNVTDLAFDLYKELADLSQTSNVLVTPTSVAMAFAMLSLGTKADTRTEILEGLNVNLTETPEAKIHECFQQVLQALSRPDTRLQLTTGSSLFVNKSMKLVDTFLEDTKKLYHSEASSINFRDTEEAKEQINNYVEKRTGRKVVDLVKHLKKDTSLALVDYISFHGKWKDKFKAERIMVEGFHVDDKTIIRVPMINHLGRFDIHRDRELSSWVLAQHYVGNATAFFILPDPKKMWQLEEKLTYSHLENIQRAFDIRSINLHFPKLSISGTYKLKRVPRNLGITKIFSNEADLSGVSQEAPLKLSKAVHVAVLTIDEKGTEATGAPHLEEKAWSKYQTVMFNRPFLVIIKEYITNFPLFIGKVVNPTQK

SEQ ID NO: 868658 - protein, 167 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETRLADWIHSSGGWELEAIKARVREMEEEAEKLKELQ

SEQ ID NO: 868659 - protein, 121 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESCFQSLGPLYPN

SEQ ID NO: 868660 - protein, 193 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETRLADWIHSSGGWAEFTALYGDGALEEARRLREGNWASVRTVLTGAVALGALVTVGAFFASK

SEQ ID NO: 868661 - protein, 193 aa, Homo sapiens; identical to SEQ ID NO: 868660

SEQ ID NO: 868662 - protein, 193 aa, Homo sapiens; identical to SEQ ID NO: 868660

SEQ ID NO: 868663 - protein, 123 aa, Homo sapiens
SEDPPIRARTLSPRPPLPPPSASFFCRSWCCLCARLVRTWYLFCEAAAEETPALAMADEKPKEGVKTENNDHINLKVAGQDGSVVQFKIKRHTPLSKLMKAYCERQGLSMRQIRFRFDGQPIK

SEQ ID NO: 868664 - protein, 128 aa, Homo sapiens
RARRVGGGSARRARTLSPRPPLPPPSASFFCRSWCCLCARLVRTWYLFCEAAAEETPALAMADEKPKEGVKTENNDHINLKVAGQDGSVVQFKIKRHTPLSKLMKAYCERQGLSMRQIRFRFDGQPIK

SEQ ID NO: 868665 - protein, 138 aa, Homo sapiens
SPETRHTIGDTPGRLHAQGPVRARTLSPRPPLPPPSASFFCRSWCCLCARLVRTWYLFCEAAAEETPALAMADEKPKEGVKTENNDHINLKVAGQDGSVVQFKIKRHTPLSKLMKAYCERQGLSMRQIRFRFDGQPIK

SEQ ID NO: 868666 - protein, 128 aa, Homo sapiens; identical to SEQ ID NO: 868664

SEQ ID NO: 868667 - protein, 128 aa, Homo sapiens; identical to SEQ ID NO: 868664

SEQ ID NO: 868668 - protein, 128 aa, Homo sapiens; identical to SEQ ID NO: 868664

SEQ ID NO: 868669 - protein, 123 aa, Homo sapiens
MDGSHQEVCVLVAKIMISVLAASFFCRSWCCLCARLVRTWYLFCEAAAEETPALAMADEKPKEGVKTENNDHINLKVAGQDGSVVQFKIKRHTPLSKLMKAYCERQGLSMRQIRFRFDGQPIK

SEQ ID NO: 868670 - protein, 128 aa, Homo sapiens; identical to SEQ ID NO: 868664

SEQ ID NO: 868671 - protein, 128 aa, Homo sapiens; identical to SEQ ID NO: 868664

SEQ ID NO: 868672 - protein, 114 aa, Homo sapiens
RARRVGGGSARRARTLSPRPPLPPPSASFFCRSWCCLCARLVRTWYLFCEAAAEETPALAMADEKPKVAGQDGSVVQFKIKRHTPLSKLMKAYCERQGLSMRQIRFRFDGQPIK

SEQ ID NO: 868673 - protein, 128 aa, Homo sapiens; identical to SEQ ID NO: 868664

SEQ ID NO: 868674 - protein, 123 aa, Homo sapiens; identical to SEQ ID NO: 868663

SEQ ID NO: 868675 - protein, 128 aa, Homo sapiens; identical to SEQ ID NO: 868664

SEQ ID NO: 868676 - protein, 117 aa, Homo sapiens
RARRVGGGSARRARTLSPRPPLPPPSASFFCRSWCCLCARLVRTWYLFCEAAAEETPALAMADEKPKEGVKTENNDHINLKVAGQDGSVVQFKIKRHTPLSKLMKAYCERQCGNWHG

SEQ ID NO: 868677 - protein, 511 aa, Homo sapiens
MAALRLLASVLGRGVPAGGSGLALSQGCARCFATSPRPRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVGASPQKTSTFLNIYVGRVIKGQKYEKRIERLTIRKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKGLTLRELWEGLTVDDIKKSTGCAFAVSPNLRPMQQVAP

SEQ ID NO: 868678 - protein, 112 aa, Homo sapiens
FPAANQMLRRDLNMRRAALCFTAAYPTQSSIPFKSQASVIPESEKKGFNSQAKRFPHKKVMTLSQGFFRFSLDFSLAGQARSVWLLCLSVDSGGQCAPRSRGTSSTEGHRLD

SEQ ID NO: 868679 - protein, 490 aa, Homo sapiens
MKKCHLGLDINNEKEAVLVSDRGAEKAPWEHGRGTSWCIVETARRPAGLVLRRTCSRTFHQTNGTRHRILLTWTTLHRKMNALANIPDVPVKYRKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPRKHFISSASFVSNTSRWTAAPPQPGLPGPATYKPELPGKQSFLYNEEQEMDPGSVGMSHKVKENSSHQPTLPSVPRTFLRRRPIMSVAADNLGGGSTTLAWHPSRTAAIAFVLSWRHCSLETSPQPHRLQWLPEQKGGVDRAPWLLPHAPIQAAFRHDSLPQTEGTPEAQTSRRISPP

SEQ ID NO: 868680 - protein, 458 aa, Homo sapiens
MDNSAQKNERTGKHPRRASEVQKGFTAAYPTQSSIPFKSQASVIPESEKKGFNSQAKRFPHKKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPRKHFISSASFVSNTSRWTAAPPQPGLPGPATYKPELPGKQSFLYNEEQEMDPGSVGMSHKVKENSSHQPTLPSVPRTFLRRRPIMSVAADNLGGGSTTLAWHPSRTAAIAFVLSWRHCSLETSPQPHRLQWLPEQKGGVDRAPWLLPHAPIQAAFRHDSLPQTEGTPEAQTSRRISPP

SEQ ID NO: 868681 - protein, 366 aa, Homo sapiens
MFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPRKHFISSASFVSNTSRWTAAPPQPGLPGPATYKPELPGKQSFLYNEEQEMDPGSVGMSHKVKENSSHQPTLPSVPRTFLRRRPIMSVAADNLGGGSTTLAWHPSRTAAIAFVLSWRHCSLETSPQPHRLQWLPEQKGGVDRAPWLLPHAPIQAAFRHDSLPQTEGTPEAQTSRRISPP

SEQ ID NO: 868682 - protein, 321 aa, Homo sapiens
MDNSAQKNERTGKHPRRASEVQKGFTAAYPTQSSIPFKSQASVIPESEKKGFNSQAKRFPHKKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPRKHFISSASFVSNTSRWTAAPPQPGLPGPGQRIVLNDCKNQ

SEQ ID NO: 868683 - protein, 116 aa, Homo sapiens
MDNSAQKNERTGKHPRRASEVQKGFTAAYPTQSSIPFKSQASVIPESEKKGFNSQAKRFPHKKVMTLSQGFFRFSLDFSLAGQARSVWLLCLSVDSGGQCAPRSRGTSSTEGHRLD

SEQ ID NO: 868684 - protein, 458 aa, Homo sapiens; identical to SEQ ID NO: 868680

SEQ ID NO: 868685 - protein, 411 aa, Homo sapiens
MNALANIPDVPVKYRKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPRKHFISSASFVSNTSRWTAAPPQPGLPGPATYKPELPGKQSFLYNEEQEMDPGSVGMSHKVKENSSHQPTLPSVPRTFLRRRPIMSVAADNLGGGSTTLAWHPSRTAAIAFVLSWRHCSLETSPQPHRLQWLPEQKGGVDRAPWLLPHAPIQAAFRHDSLPQTEGTPEAQTSRRISPP

SEQ ID NO: 868686 - protein, 458 aa, Homo sapiens; identical to SEQ ID NO: 868680

SEQ ID NO: 868687 - protein, 218 aa, Homo sapiens
MNALANIPDVPVKYRKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPGGSKASDLAGHLPKSTQPT

SEQ ID NO: 868688 - protein, 197 aa, Homo sapiens
MDNSAQKNERTGKHPRRASEVQKGFTAAYPTQSSIPFKSQASVIPESEKKGFNSQAKRFPHKKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGCGGTYL

SEQ ID NO: 868689 - protein, 407 aa, Homo sapiens
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCCVDATTFLYFSFFAPLIYVAFLRGFFGGVCGRRRPRVAAGGTAPSSSMGVRIEAERLCMHTVRMRTHIHTCTWAHTYRYTCTCTQIYAHPPTCAWTRAHAHTDAQACTHAHAHTNTHIRIHTGICTQTCTCTPTCMHTHMNTCSTYTYM

SEQ ID NO: 868690 - protein, 285 aa, Homo sapiens
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCCVDATTFLYFSFFAPLIYVAFLRGFFG

SEQ ID NO: 868691 - protein, 285 aa, Homo sapiens; identical to SEQ ID NO: 868690

SEQ ID NO: 868692 - protein, 285 aa, Homo sapiens; identical to SEQ ID NO: 868690

SEQ ID NO: 868693 - protein, 285 aa, Homo sapiens; identical to SEQ ID NO: 868690

SEQ ID NO: 868694 - protein, 43 aa, Homo sapiens
MGVRIEAERLCMHTVRMRTHIHTCTWAHTYRYTCTCTQIYAHP

SEQ ID NO: 868695 - protein, 163 aa, Homo sapiens
LKPHDLCPFFLHTVSTHPFHHEEAGTDAPRLSSHSQGEEGWGFQNKSRWALGSSSQAHSEWVSGDCWSIPSLSGGPISLERKALPESLSEASMPLFSFYQLGAQDPLLLQMPSGRDRGARCTPTPALRCGPAGGPGGCRGCWGLSCQLLEHASRLCRRGGLPG

SEQ ID NO: 868696 - protein, 350 aa, Homo sapiens
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCCVDATTFLYFSFFAPLIYVAFLRGFFGSEPKILFSYKCQVDETEEPDVHLPQPYAVARREGLEAAGAAGASAASYSSTHLDSAGGVAYLDDI

SEQ ID NO: 868697 - protein, 216 aa, Homo sapiens
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVRFRLGQLGWLGP

SEQ ID NO: 868698 - protein, 285 aa, Homo sapiens; identical to SEQ ID NO: 868690

SEQ ID NO: 868699 - protein, 442 aa, Homo sapiens
MRPLHIQDRSKEKNGTQSHSSPAVLSQVSGLAAGGMDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCCVDATTFLYFSFFAPLIYVAFLRGFFGGVCGRRRPRVAAGGTAPSSSMGVRIEAERLCMHTVRMRTHIHTCTWAHTYRYTCTCTQIYAHPPTCAWTRAHAHTDAQACTHAHAHTNTHIRIHTGICTQTCTCTPTCMHTHMNTCSTYTYM

SEQ ID NO: 868700 - protein, 328 aa, Homo sapiens
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVRFRLGQLGWLGPEGQVGIGFLGFWLWVWAGAPSTFSALPVSVVYSLVVILPKTPLKERISLPSRRSFYVYAGILALLNLLQGLGSVLLCFDIIEGLCCVDATTFLYFSFFAPLIYVAFLRGFFG

SEQ ID NO: 868701 - protein, 110 aa, Homo sapiens
MSLFAQPFLVWRQEAGSANFLFHHGDTEAYGTSQTLDPKLVPGRDSSLQPLTSTTTLLSPGPWTLTKAVTSPTPPKLVAAISTFSHGSLCVQRCNSRSWVSWLTPIIPAL

SEQ ID NO: 868702 - protein, 187 aa, Homo sapiens
DLSRIRIAESSLLPRRAPNHLLTMGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRIPI

SEQ ID NO: 868703 - protein, 585 aa, Homo sapiens
DLSRIRIAESSLLPRRAPNHLLTMGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSQTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 868704 - protein, 263 aa, Homo sapiens
MHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 868705 - protein, 244 aa, Homo sapiens
MWRSRGPPVDWTSRKIGPLRKMASAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 868706 - protein, 536 aa, Homo sapiens
DLSRIRIAESSLLPRRAPNHLLTMGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSQTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 868707 - protein, 585 aa, Homo sapiens; identical to SEQ ID NO: 868703

SEQ ID NO: 868708 - protein, 482 aa, Homo sapiens
DLSRIRIAESSLLPRRAPNHLLTMGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSQTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKVCSGSFLMWPSDFGKEPAQMLSPIFQSGS

SEQ ID NO: 868709 - protein, 36 aa, Homo sapiens
MKSDSLLEKSRGKSKGHLVLDLICDQISHRELEHHV

SEQ ID NO: 868710 - protein, 178 aa, Homo sapiens
MADAVYVIFILHWKKLPIQGTYSRHNGSCLKSLLADCASKPQTETHSLSTGQKSEVRPVLERLRSLWPQIPPLQSEQAAWVSGIWPSVSVPEALCQVPGKGTGEERSEEMHDCEYPHPCSGYDSHPGMRELGKGFYPPLYFALDSGQDPAPALPSVLSDLKNLWAQSIPFESIMCLQH

SEQ ID NO: 868711 - protein, 333 aa, Homo sapiens
MPANYTCTRPDGDNTDFRYFIYAVTYTVILVPGLIGNILALWVFYGYMKETKRAVIFMINLAIADLLQVLSLPLRIFYYLNHDWPFGPGLCMFCFYLKYVNMYASIYFLVCISVRRFWFLMYPFRFHDCKQKYDLYISIAGWLIICLACVLFPLLRTSDDTSGNRTKCFVDLPTRNVNLAQSVVMMTIGELIGFVTPLLIVLYCTWKTVLSLQDKYPMAQDLGEKQKALKMILTCAGVFLICFAPYHFSFPLDFLVKSNEIKSCLARRVILIFHSVALCLASLNSCLDPVIYYFSTNEFRRRLSRQDLHDSIQLHAKSFVSNHTASTMTPELC

SEQ ID NO: 868712 - protein, 158 aa, Homo sapiens
DPTSEQPQLGGAVRRAEREWAGRGHPGRCRSGGPRLTPLPPQGCICYRPEEHQVCFLRLMEDSDRETLRLLVDTSKVQEAWVPSQDTHHTQELLAVQGSLEVDPAQAGALVQRLCMRTPIYWARRAEGPRRQRLIYLCIDICFPSNICVSVCFYYLPD

SEQ ID NO: 868713 - protein, 133 aa, Homo sapiens
TPPQSNHSWAVLFDGQSGCICYRPEEHQVCFLRLMEDSDRETLRLLVDTSKVQEAWVPSQDTHHTQELLAVQGSLEVDPAQAGALVQRLCMRTPIYWARRAEGPRRQRLIYLCIDICFPSNICVSVCFYYLPD

SEQ ID NO: 868714 - protein, 518 aa, Homo sapiens
MAGYKPVAIQTYPILGEKITQDTLYWNNYKTPVQIKEFGAVSKVDFSPQPPYNYAVTASSRIHIYGRYSQEPIKTFSRFKDTAYCATFRQDGRLLVAGSEDGGVQLFDISGRAPLRQFEGHTKAVHTVDFTADKYHVVSGADDYTVKLWDIPNSKEILTFKEHSDYVRCGCASKLNPDLFITGSYDHTVKMFDARTSESVLSVEHGQPVESVLLFPSGGLLVSAGGRYVKVWDMLKGGQLLVSLKNHHKTVTCLCLSSSGQRLLSGSLDRKVKVYSTTSYKVVHSFDYAASILSLALAHEDETIVVGMTNGILSVKHRKSEAKKESLPRRRRPAYRTFIKGKNYMKQRDDILINRPAKKHLELYDRDLKHFRISKALDRVLDPTCTIKTPEITVSIIKELNRRGVLANALAGRDEKEISHVLNFLIRNLSQPRFAPVLINAAEIIIDIYLPVIGQSPVVDKKFLLLQGLVEKEIDYQRELLETLGMMDMLFATMRRKEGTSVLEHTSDGFPENKKIES

SEQ ID NO: 868715 - protein, 518 aa, Homo sapiens; identical to SEQ ID NO: 868714

SEQ ID NO: 868716 - protein, 518 aa, Homo sapiens; identical to SEQ ID NO: 868714

SEQ ID NO: 868717 - protein, 477 aa, Homo sapiens
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 868718 - protein, 477 aa, Homo sapiens; identical to SEQ ID NO: 868717

SEQ ID NO: 868719 - protein, 459 aa, Homo sapiens
MDGFYDQQVPYMVTNSQRGRNCNEKPTNVRKRKFINRDLAHDSEELFQDLSQLQETWLAEVAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 868720 - protein, 123 aa, Homo sapiens
MDGFYDQQVPYMVTNSQRGRNCNEKPTNVRKRKFINRDLAHDSEELFQDLSQLQETWLAEAQVPDNDEQFVPDYQAESYMSGYWLLATVLVSTALNSDVFHIVVSSLVLPSEAVHWTSSPDPC

SEQ ID NO: 868721 - protein, 477 aa, Homo sapiens; identical to SEQ ID NO: 868717

SEQ ID NO: 868722 - protein, 459 aa, Homo sapiens; identical to SEQ ID NO: 868719

SEQ ID NO: 868723 - protein, 407 aa, Homo sapiens
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVSS

SEQ ID NO: 868724 - protein, 261 aa, Homo sapiens
MASQLQNRLRSALALVTGAGSGIGRAVSVRLAGEGATVAACDLDRAAAQETVRLLGGPGSKEGPPRGNHAAFQADVSEARAARCLLEQVQACFSRPPSVVVSCAGITQDEFLLHMSEDDWDKVIAVNLKGTFLVTQAAAQALVSNGCRGSIINISSIVGKVGNVGQTNYAASKAGVIGLTQTAARELGRHGIRCNSVLPGFIATPMTQKVPQKVVDKITEMIPMGHLGDPEDVADVVAFLASEDSGYITGTSVEVTGGLFM

SEQ ID NO: 868725 - protein, 110 aa, Homo sapiens
MQSLSFWGEWGPLSSPHPGPLSSSVGPRPLGGRSACAGGRRWPKAGGPLIGPGFALATPLCAGIGLVLGFPPTHSPPWRLSSRTDSAPHWPWSQVEGVLSPGGLGYWSEV

SEQ ID NO: 868726 - protein, 261 aa, Homo sapiens; identical to SEQ ID NO: 868724

SEQ ID NO: 868727 - protein, 147 aa, Homo sapiens [sequence omitted]

SEQ ID NO: 868728 - protein, 147 aa, Homo sapiens
MSEDDWDKVIAVNLKGTFLVTQAAAQALVSNGCRGSIINISSIVGKVGNVGQTNYAASKAGVIGLTQTAARELGRHGIRCNSVLPGFIATPMTQKVPQKVVDKVGGCGWRAESFRDSISLGFTEREREREREYWAQFLANIKYSMNV

SEQ ID NO: 868729 - protein, 172 aa, Homo sapiens
SPLNRSPPSIPDTMTHCCSPCCQPTCCRTTCWQPTTVTTCSSTPCCQPSCCVSSCCQPCCHPTCCQNTCCRTTCCQPICVTSCCQPSCCSTPCCQPTCCGSSCGQSSSCAPVYCRRTCYHPTSVCLPGCLNQSCGSNCCQPCCRPACCETTCCRTTCFQPTCVYSCCQPSCC

SEQ ID NO: 868730 - protein, 1256 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868731 - protein, 200 aa, Homo sapiens
PSCPPFARGPERDRGTCRAGRRLCRGPWTPPPPWPGSLPRRSGRQRGAPRAAGTGPGPPHGAQPRASRGKSPWAAAMALKMVKGSIDRMFDKNLQDLVRGIRNHKEDEVRGRAVGLGECFVASRVGQHPQPAGPGPLYRSPGEQAVTKMSNPFLKQVFNKDKTFRPKRKFEPGTQRFELHKKAQASLNAGLDLRLAVQLP

SEQ ID NO: 868732 - protein, 931 aa, Homo sapiens
MSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868733 - protein, 1306 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868734 - protein, 1318 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTGELSVNTVTTPKDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868735 - protein, 1323 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGRVLGHTLPCVALLSGCSLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868736 - protein, 910 aa, Homo sapiens
MPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868737 - protein, 1306 aa, Homo sapiens; identical to SEQ ID NO: 868733

SEQ ID NO: 868738 - protein, 930 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIASPTKPSMCSPSRASSWRRSSRGPCPSLPRMTRVRPTRSWTSGCTSAAAPT

SEQ ID NO: 868739 - protein, 1306 aa, Homo sapiens; identical to SEQ ID NO: 868733

SEQ ID NO: 868740 - protein, 845 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKR

SEQ ID NO: 868741 - protein, 487 aa, Homo sapiens
AQSFPAAEAGGGAEAGSRKRQKQEDRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868742 - protein, 1306 aa, Homo sapiens; identical to SEQ ID NO: 868733

SEQ ID NO: 868743 - protein, 92 aa, Homo sapiens
AKALGVGRTSGPTDENDIPFLRRIRIPVFHHHFSVVERVDSCASMYSRSIQGHHVCLLVKKGENSVSVDGKCSDSTLLSNLLEEMKATLAKC

SEQ ID NO: 868744 - protein, 1313 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMVSGSRSQGQGGPAHTLWHGIARNPGSPHSSRMLVYPGPVIPGRGVAWAAPLAWGKVGDMALRLGLAGGSPPCTQRAAIGGAWPAAEGAPLSVPSCACGTPAASVVIKRQVAVPVPCGGPACPANTGHALQTCDIRGSLQEDSQVTVAIVLENRSSSILKGMELSVLDSLNARMARPQGSSVHDGVPVPFQLPPGVSNEAQYVFTIQSIVMAQKLKGTLSFIAKVCRA

SEQ ID NO: 868745 - protein, 372 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARTPKRGCSQNRGRGGLRPLCHPSSWSAEVHLGLGLGRGPHPLLATMRTKVSPHPSQHP

SEQ ID NO: 868746 - protein, 707 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVFVHCCYEL

SEQ ID NO: 868747 - protein, 828 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDLCT

SEQ ID NO: 868748 - protein, 220 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGRAWKQRTWAVLC

SEQ ID NO: 868749 - protein, 113 aa, Homo sapiens
MGLLPGLGHAALQDWSLCTSAHGPLGGGLGPQHHPGLGLGQSQARESPTPWWPRSPASPPKAVQGSRCLLSLPFPRSPRGRGRSRIENRGRAATPPLGEFASFTPALHLEDGS

SEQ ID NO: 868750 - protein, 1150 aa, Homo sapiens
FNIIEGGQLMSYPNICKYISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868751 - protein, 1343 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSGLLKLWPRAAQEGGPCSGGGAAAMQCPGSLNTARSVAVVERVDSCASMYSRSIQGHHVCLLVKKGENSVSVDGKCSDSTLLSNLLEEMKATLAKC

SEQ ID NO: 868752 - protein, 1306 aa, Homo sapiens; identical to SEQ ID NO: 868733

SEQ ID NO: 868753 - protein, 1306 aa, Homo sapiens; identical to SEQ ID NO: 868733

SEQ ID NO: 868754 - protein, 1306 aa, Homo sapiens; identical to SEQ ID NO: 868733

SEQ ID NO: 868755 - protein, 587 aa, Homo sapiens
CVYYKDAGANRANGECNVHIVRAVAASDYEVCILNDRAQAEVPGRYKLGSHRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868756 - protein, 486 aa, Homo sapiens
LTRWRPKRKLEWERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 868757 - protein, 1306 aa, Homo sapiens; identical to SEQ ID NO: 868733

SEQ ID NO: 868758 - protein, 478 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDRDRSPDVSRLSSVVCTVPKPEC

SEQ ID NO: 868759 - protein, 1197 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKLRTWTSGFYHPGIPEARWTRDLKDGKEIDALDKSTEREHGVRNEGSHGSRRPLNDLDVSELGQHRRYDNDDIIEWKPKPHNKEPNGWGTHTGSGNMPTRQPSCRRREQPTTQERERQKREANKKRQAQARPEQRRPHTHMPEIGENRKHQDPEKTQASRRKEGSTTRQTRGQLTRYIIPKRDKGGASSMIEHERPHEEYAATPGTVAAEYAIRVEAGQRYSRETSEG

SEQ ID NO: 868760 - protein, 876 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKNTNYPFLLGPAACHAPRISASA

SEQ ID NO: 868761 - protein, 422 aa, Homo sapiens
PSLSVNLTLCCPPCKHPRSFVALNYLTILFYCDSSHSLWQEVPFSPPNQQGTPPPGSVPCPALGAESLNVASGAPVLTVASGGGEGRAAVAKVFSPRTPWAAAMALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLGVQKLRIWMLDDGYRA

SEQ ID NO: 868762 - protein, 102 aa, Homo sapiens
NYLSLAPLFFKLMTSSTNNWVLIKIIKLASTARECGLLTLCGASLTLCGAFPAGDRGPPCPSPCVGHSLRVTEALLSPQFGALTPLEPRLGKKLIEPLTNLI

SEQ ID NO: 868763 - protein, 68 aa, Homo sapiens
ISLLLLLVTQASDVPPRASWPRPLSLTFQDLSSPSQYDTGVALTGLSCFVTPDLARDLANDIMTLVSL

SEQ ID NO: 868764 - protein, 600 aa, Homo sapiens
MSRVAKYRRQVSEDPDIDSLLETLSPEEMEELEKELDVVDPDGSVPVGLRQRNQTEKQSTGVYNREAMLNFCEKETKKLMQREMSMDESKQVETKTDAKNGEERGRDASKKALGPRRDSDLGKEPKRGGLKKSFSRDRDEAGGKSGEKPKEEKIIRGIDKGRVRAAVDKKEAGKDGRGEERAVATKKEEEKKGSDRNTGLSRDKDKKREEMKEVAKKEDDEKVKGERRNTDTRKEGEKMKRAGGNTDMKKEDEKVKRGTGNTDTKKDDEKVKKNEPLHEKEAKDDSKTKTPEKQTPSGPTKPSEGPAKVEEEAAPSIFDEPLERVKNNDPEMTEVNVNNSDCITNEILVRFTEALEFNTVVKLFALANTRADDHVAFAIAIMLKANKTITSLNLDSNHITGKGILAIFRALLQNNTLTELRFHNQRHICGGKTEMEIAKLLKENTTLLKLGYHFELAGPRMTVTNLLSRNMDKQRQKRLQEQRQAQEAKGEKKDLLEVPKAGAVAKGSPKPSPQPSPKPSPKNSPKKGGAPAAPPPPPPPLAPPLIMENLKNSLSPATQRKMGDKVLPAQEKNSRDQLLAAIRSSNLKQLKKVEVPKLLQ

SEQ ID NO: 868765 - protein, 108 aa, Homo sapiens
MSRVAKYRRQVSEDPDIDSLLETLSPEEMEELEKELDVVDPDGSVPVGLRQRNQTEKQSTGVYNREAMLNFCEKETKKLMQREMSMDVSTALEGRRETGEGWRPWLHD

SEQ ID NO: 868766 - protein, 522 aa, Homo sapiens
MTYPRSHSSRKAEQVQTTDAKNGEERGRDASKKALGPRRDSDLGKEPKRGGLKKSFSRDRDEAGGKSGEKPKEEKIIRGIDKGRVRAAVDKKEAGKDGRGEERAVATKKEEEKKGSDRNTGLSRDKDKKREEMKEVAKKEDDEKVKGERRNTDTRKEGEKMKRAGGNTDMKKEDEKVKRGTGNTDTKKDDEKVKKNEPLHEKEAKDDSKTKTPEKQTPSGPTKPSEGPAKVEEEAAPSIFDEPLERVKNNDPEMTEVNVNNSDCITNEILVRFTEALEFNTVVKLFALANTRADDHVAFAIAIMLKANKTITSLNLDSNHITGKGILAIFRALLQNNTLTELRFHNQRHICGGKTEMEIAKLLKENTTLLKLGYHFELAGPRMTVTNLLSRNMDKQRQKRLQEQRQAQEAKGEKKDLLEVPKAGAVAKGSPKPSPQPSPKPSPKNSPKKGGAPAAPPPPPPPLAPPLIMENLKNSLSPATQRKMGDKVLPAQEKNSRDQLLAAIRSSNLKQLKKVEVPKLLQ

SEQ ID NO: 868767 - protein, 600 aa, Homo sapiens; identical to SEQ ID NO: 868764

SEQ ID NO: 868768 - protein, 600 aa, Homo sapiens; identical to SEQ ID NO: 868764

SEQ ID NO: 868769 - protein, 297 aa, Homo sapiens
MSRVAKYRRQVSEDPDIDSLLETLSPEEMEELEKELDVVDPDGSVPVGLRQRNQTEKQSTGVYNREAMLNFCEKETKKLMQREMSMDESKQVETKTDAKNGEERGRDASKKALGPRRDSDLGKEPKRGGLKKSFSRDRDEAGGKSGEKPKEEKIIRGIDKGRVRAAVDKKEAGKDGRGEERAVATKKEEEKKGSDRNTGLSRDKDKKREEMKEVAKKEDDEKVKGGAPAAPPPPPPPLAPPLIMENLKNSLSPATQRKMGDKVLPAQEKNSRDQLLAAIRSSNLKQLKKVEVPKLLQ

SEQ ID NO: 868770 - protein, 514 aa, Homo sapiens
MESKQVETKTDAKNGEERGRDASKKALGPRRDSDLGKEPKRGGLKKSFSRDRDEAGGKSGEKPKEEKIIRGIDKGRVRAAVDKKEAGKDGRGEERAVATKKEEEKKGSDRNTGLSRDKDKKREEMKEVAKKEDDEKVKGERRNTDTRKEGEKMKRAGGNTDMKKEDEKVKRGTGNTDTKKDDEKVKKNEPLHEKEAKDDSKTKTPEKQTPSGPTKPSEGPAKVEEEAAPSIFDEPLERVKNNDPEMTEVNVNNSDCITNEILVRFTEALEFNTVVKLFALANTRADDHVAFAIAIMLKANKTITSLNLDSNHITGKGILAIFRALLQNNTLTELRFHNQRHICGGKTEMEIAKLLKENTTLLKLGYHFELAGPRMTVTNLLSRNMDKQRQKRLQEQRQAQEAKGEKKDLLEVPKAGAVAKGSPKPSPQPSPKPSPKNSPKKGGAPAAPPPPPPPLAPPLIMENLKNSLSPATQRKMGDKVLPAQEKNSRDQLLAAIRSSNLKQLKKVEVPKLLQ

SEQ ID NO: 868771 - protein, 82 aa, Homo sapiens
LGPCKHRCMNTYGSYKCYCLNGYMLMPDGSCSSALTCSMANCQYGCDVVKGQIRCQCPSPGLHLAPDGRTCVDVDECATGRA

SEQ ID NO: 868772 - protein, 600 aa, Homo sapiens
MSRVAKYRRQVSEDPDIDSLLETLSPEEMEELEKELDVVDPDGSVPVGLRQRNQTEKQSTGVYNREAMLNFCEKETKKLMQREMSMDESKQVETKTDAKNGEERGRDASKKALGPRRDSDLGKEPKRGGLKKSFSRDRDEAGGKSGEKPKEEKIIRGIDKGRVRAAVDKKEAGKDGRGEERAVATKKEEEKKGSDRNTGLSRDKDKKREEMKEVAKKEDDEKVKGERRNTDTRKEGEKMKRAGGNTDMKKEDEKVKRGTGNTDTKKDDEKVKKNEPLHEKEAKDDSKTKTPEKQTPSGPTKPSEGPAKVEEEAAPSIFDEPLERVKNNDPEMTEVNVNNSDCITNEILVRFTEALEFNTVVKLFALANTRADDHVAFAIAIMLKANKTITSLNLDSNHITGKGILAIFRALLQNNTLTELRFHNQRHICGGKTEMEIAKLLKENTTLLKLGYHFELAGPRMTVTNLLSRNMDKQRQKRLQEQRQAQEAKGEKKDLLEVPKAGAVAKGSPKPSPQPSPKPSPKNSPKKGGAPAAPPPPPPPLAPPLIMENLKNSLSPATQRKMGDKVLPAQEKNSRDQLLAAIRSSNLKQLKTLCLLGTGH

SEQ ID NO: 868773 - protein, 78 aa, Homo sapiens
LKNSLSPATQRKMGDKVLPAQEKNSRDQLLAAIRSSNLKQLKISSCGHEPTGRGWVGPGGEGRTAKGKACRGAYVGCR

SEQ ID NO: 868774 - protein, 71 aa, Homo sapiens
RASAEVAMEESGYESVLCVKPDVHVYRIPPRATNLATGELFAARIQISPSQGLQVSHDHSSAGGFPYPHWL

SEQ ID NO: 868775 - protein, 82 aa, Homo sapiens
MCFLSLVVYVMNHIYCFACVEPTLHPRDKAYLIMMGKLFDVLVGLFCQYFIEDFCIDVHQGYWPYFFIVSLPGFGIRRMLAS

SEQ ID NO: 868776 - protein, 1076 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868777 - protein, 828 aa, Homo sapiens [sequence omitted]

SEQ ID NO: 868778 - protein, 356 aa, Homo sapiens
MTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868779 - protein, 356 aa, Homo sapiens; identical to SEQ ID NO: 868778

SEQ ID NO: 868780 - protein, 977 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEV

SEQ ID NO: 868781 - protein, 1005 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSTTDHTHAYEHIPQTRMKKTVNLIHESCGVGGSNTRTNRTSGTHDNQANCEETGRTKGAEGSHTKKKSAVVTIATTVVRSMGRNVGTRQETCVEADLKAGGPGPHRTMETAGRYTRVTELGSAGEQRCAHKE

SEQ ID NO: 868782 - protein, 724 aa, Homo sapiens
MNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868783 - protein, 724 aa, Homo sapiens; identical to SEQ ID NO: 868782

SEQ ID NO: 868784 - protein, 481 aa, Homo sapiens
MALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868785 - protein, 481 aa, Homo sapiens; identical to SEQ ID NO: 868784

SEQ ID NO: 868786 - protein, 654 aa, Homo sapiens
EDPQCRLLPDEESEYRMKTWRHWQVVQVNSYQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868787 - protein, 528 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWLT

SEQ ID NO: 868788 - protein, 386 aa, Homo sapiens
AANETRTKDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868789 - protein, 276 aa, Homo sapiens
MPKTCQCYVGTKTTNPSAWPSREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868790 - protein, 136 aa, Homo sapiens
MRRKSKIWIKQGNEENLFDSLTGQPHPEDVTTVAIPICAPYTTMTNYKYKVKLTETESRMVAARGWGEKTIEELLIGSEFQFYKMKIILWIRVAKMAQQCKCTQYHRTVHLKSKGGQAQWLTPVIPALWEAEAGGS

SEQ ID NO: 868791 - protein, 1076 aa, Homo sapiens; identical to SEQ ID NO: 868776

SEQ ID NO: 868792 - protein, 1108 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVLFNFLVIYLFFSCFSLVLSEAPSLKNNCFFEVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868793 - protein, 1010 aa, Homo sapiens [sequence omitted]

SEQ ID NO: 868794 - protein, 1105 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQVIMFGFLSAFSKMLTLTGNVVNVCGLFFKEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868795 - protein, 1034 aa, Homo sapiens
MKSRFSTIDLRAVLAELNASLLGMRVNNVYDVDNKTYLIRLQKPDFKATLLLESGIRIHTTEFEWPKNMMPSSFAMKGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868796 - protein, 1012 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYK

SEQ ID NO: 868797 - protein, 828 aa, Homo sapiens [sequence omitted]

SEQ ID NO: 868798 - protein, 874 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKM

SEQ ID NO: 868799 - protein, 671 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVLFNFLVIYLFFS

SEQ ID NO: 868800 - protein, 678 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDEFVFGDIYLKKEAKPARP

SEQ ID NO: 868801 - protein, 397 aa, Homo sapiens
METLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 868802 - protein, 253 aa, Homo sapiens [sequence omitted]

SEQ ID NO: 868803 - protein, 323 aa, Homo sapiens [sequence omitted]

SEQ ID NO: 868804 - protein, 104 aa, Homo sapiens
EGVCCQLEKLRPNYDHPIFNWSRIGLCKNYVLSFSVNPDWRNLPRSWLVWKREVSTKVKSLTKPVARETPRAGQKRPFRWKTGPSPTCCRSPDPPSCASTTGAA

SEQ ID NO: 868805 - protein, 177 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEGPRQSMGHEIKSELLMGGCSWIRGKIQCDRVQVRRPGFSSQL

SEQ ID NO: 868806 - protein, 126 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVKGLASPVGGVGGSRWMLGWVCCGEGACAWL

SEQ ID NO: 868807 - protein, 177 aa, Homo sapiens; identical to SEQ ID NO: 868805

SEQ ID NO: 868808 - protein, 177 aa, Homo sapiens; identical to SEQ ID NO: 868805

SEQ ID NO: 868809 - protein, 270 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAPSGRNLTPAELPAKQREQLLGICDAALCRQVQLLGVRLVVGVGRLAEQRARRALAGLMPEVQVEGLLHPSPRNPQANKGWEAVAKERLNELGLLPLLLK

SEQ ID NO: 868810 - protein, 270 aa, Homo sapiens; identical to SEQ ID NO: 868809

SEQ ID NO: 868811 - protein, 270 aa, Homo sapiens; identical to SEQ ID NO: 868809

SEQ ID NO: 868812 - protein, 270 aa, Homo sapiens; identical to SEQ ID NO: 868809

SEQ ID NO: 868813 - protein, 270 aa, Homo sapiens; identical to SEQ ID NO: 868809

SEQ ID NO: 868814 - protein, 270 aa, Homo sapiens; identical to SEQ ID NO: 868809

SEQ ID NO: 868815 - protein, 177 aa, Homo sapiens; identical to SEQ ID NO: 868805

SEQ ID NO: 868816 - protein, 177 aa, Homo sapiens; identical to SEQ ID NO: 868805

SEQ ID NO: 868817 - protein, 126 aa, Homo sapiens; identical to SEQ ID NO: 868806

SEQ ID NO: 868818 - protein, 270 aa, Homo sapiens; identical to SEQ ID NO: 868809

SEQ ID NO: 868819 - protein, 177 aa, Homo sapiens; identical to SEQ ID NO: 868805

SEQ ID NO: 868820 - protein, 270 aa, Homo sapiens; identical to SEQ ID NO: 868809

SEQ ID NO: 868821 - protein, 270 aa, Homo sapiens; identical to SEQ ID NO: 868809

SEQ ID NO: 868822 - protein, 270 aa, Homo sapiens; identical to SEQ ID NO: 868809

SEQ ID NO: 868823 - protein, 270 aa, Homo sapiens; identical to SEQ ID NO: 868809

SEQ ID NO: 868824 - protein, 179 aa, Homo sapiens
GSRGLGIRDCGGKLTAPRVVGAEPRGWLEFLYFGVPPSVWGKTQCRESPAYETAWEVCRIKAFQSAGASGRPRRLECNGAISAHCSLRLPGSSDSSASASRVADYELTESLAYILLFLDFFLIKRLLRCLSCDSGMDICPRLSCWGPSMSLQVPSWSPSPALEAWLRASWRRSFGSMLS

SEQ ID NO: 868825 - protein, 226 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAPSGRNLTPAELPAKQREQLLGICDAALCRQVQLLGVRLVVGVSRLIQRRTTNGCF

SEQ ID NO: 868826 - protein, 218 aa, Homo sapiens
MKPPGRSAGSRLSSRPEPAGAPGADYELTESLAYILLFLDFFLIKRLLRCLSCDSGMDICPRLSCWGPSMSLQVPSWSPSPALEAWLRAEPVGIIYNPVEYAWEPHRNYVTRYCQGPKEVLFLGMNPGPFGMAQTGVPFGEVSMVRDWLGIVGPVLTPPQEHPKRPVLGLECPQSEGPRQSMGHEIKSELLMGGCSWIRGKIQCDRVQVRRPGFSSQL

SEQ ID NO: 868827 - protein, 1025 aa, Homo sapiens
MSNGYSTDENFRYLISCFRARVKMYIQVEPVLDYLTFLPAEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAEIENLSQVDGPQVEEQLLSTTVQPNLEKEVWGMENNSSESSFADSSVVSESDTSLAEGSVSCLDESLGHNSNMGSDSGTMGSDSDEENVAARASPEPELQLRPYQMEVAQPALEGKNIIICLPTGSGKTRVAVYIAKDHLDKKKKASEPGKVIVLVNKVLLVEQLFRKEFQPFLKKWYRVIGLSGDTQLKISFPEVVKSCDIIISTAQILENSLLNLENGEDAGVQLSDFSLIIIDECHHTNKEAVYNNIMRHYLMQKLKNNRLKKENKPVIPLPQILGLTASPGVGGATKQAKAEEHILKLCANLDAFTIKTVKENLDQLKNQIQEPCKKFAIADATREDPFKEKLLEIMTRIQTYCQMSPMSDFGTQPYEQWAIQMEKKAAKEGNRKERVCAEHLRKYNEALQINDTIRMIDAYTHLETFYNEEKDKKFAVIEDDSDEGGDDEYCDGDEDEDDLKKPLKLDETDRFLMTLFFENNKMLKRLAENPEYENEKLTKLRNTIMEQYTRTEESARGIIFTKTRQSAYALSQWITENEKFAEVGVKAHHLIGAGHSSEFKPMTQNEQKEVISKFRTGKINLLIATTVAEEGLDIKECNIVIRYGLVTNEIAMVQARGRARADESTYVLVAHSGSGVIEHETVNDFREKMMYKAIHCVQNMKPEEYAHKILELQMQSIMEKKMKTKRNIAKHYKNNPSLITFLCKNCSVLACSGEDIHVIEKMHHVNMTPEFKELYIVRENKALQKKCADYQINGEIICKCGQAWGTMMVHKGLDLPCLKIRNFVVVFKNNSTKKQYKKWVELPITFPNLDYSECCLFSDED

SEQ ID NO: 868828 - protein, 1026 aa, Homo sapiens
LQIRYPSTDSGSAPSPLQAERSGQSSTGSTWMYIFTLALKHEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAEIENLSQVDGPQVEEQLLSTTVQPNLEKEVWGMENNSSESSFADSSVVSESDTSLAEGSVSCLDESLGHNSNMGSDSGTMGSDSDEENVAARASPEPELQLRPYQMEVAQPALEGKNIIICLPTGSGKTRVAVYIAKDHLDKKKKASEPGKVIVLVNKVLLVEQLFRKEFQPFLKKWYRVIGLSGDTQLKISFPEVVKSCDIIISTAQILENSLLNLENGEDAGVQLSDFSLIIIDECHHTNKEAVYNNIMRHYLMQKLKNNRLKKENKPVIPLPQILGLTASPGVGGATKQAKAEEHILKLCANLDAFTIKTVKENLDQLKNQIQEPCKKFAIADATREDPFKEKLLEIMTRIQTYCQMSPMSDFGTQPYEQWAIQMEKKAAKEGNRKERVCAEHLRKYNEALQINDTIRMIDAYTHLETFYNEEKDKKFAVIEDDSDEGGDDEYCDGDEDEDDLKKPLKLDETDRFLMTLFFENNKMLKRLAENPEYENEKLTKLRNTIMEQYTRTEESARGIIFTKTRQSAYALSQWITENEKFAEVGVKAHHLIGAGHSSEFKPMTQNEQKEVISKFRTGKINLLIATTVAEEGLDIKECNIVIRYGLVTNEIAMVQARGRARADESTYVLVAHSGSGVIEHETVNDFREKMMYKAIHCVQNMKPEEYAHKILELQMQSIMEKKMKTKRNIAKHYKNNPSLITFLCKNCSVLACSGEDIHVIEKMHHVNMTPEFKELYIVRENKALQKKCADYQINGEIICKCGQAWGTMMVHKGLDLPCLKIRNFVVVFKNNSTKKQYKKWVELPITFPNLDYSECCLFSDED

SEQ ID NO: 868829 - protein, 221 aa, Homo sapiens
LQIRYPSTDSGSAPSPLQAERSGQSSTGSTWMYIFTLALKHEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAGICNFTEEDSSNS

SEQ ID NO: 868830 - protein, 1026 aa, Homo sapiens; identical to SEQ ID NO: 868828

SEQ ID NO: 868831 - protein, 230 aa, Homo sapiens
SGGVQRRPGQQRLEFQMPWKEESEFTKQDKAARVIQQAWKSFLNVAIFQHFKSLIDLRRQGEPRQIVKYINPKEAELLDAAAGIHVRFRLGGVKFPPDIYYKIFTHRPIEDLCANSPRNYAKLPAKHTSHNKNDHLQEEDHSGWYHRIENNGWRPVSDTFWLSTDGMVVEDKKESEFHFSKLKRRQDLEKKRKLRKIEWMRQMYYSGSLEAKSTHHETLGLISHCNKGAD

SEQ ID NO: 868832 - protein, 252 aa, Homo sapiens
MPWKEESEFTKQDKAARVIQQAWKSFLNVAIFQHFKSLIDLRRQGEPRQIVKYINPKEAELLDAAAGIHVRFRLGGVKFPPDIYYKIFTHRPIEDLCANSPRNYAKLPAKHTSHNKNDHLQEEDHSGWYHRIENNGWRPVSDTEWLSTDGMDGGQTKKATGDPISIINRHEKARLRQTEHGQTLRKKNRSRLKAHRYTTGQGKTGQAYRTTTKLSEKAVGNSDPRTGKPHEGDADTSRTTTAAGLNREDGTR

SEQ ID NO: 868833 - protein, 208 aa, Homo sapiens
SAQAGQQRLEFQMPWKEESEFTKQDKAARVIQQAWKSFLNVAIFQHFKSLIDLRRQGEPRQIVKYINPKEVKFPPDIYYKIFTHRPIEDLCANSPRNYAKLPAKHTSHNKNDHLQEEDHSGWYHRIENNGWRPVSDTFWLSTDGMVVEDKKESEFHFSKLKRRQDLEKKRKLRKIEWMRQMYYSGSLEAKSTHHETLGLISHCNKGAD

SEQ ID NO: 868834 - protein, 946 aa, Homo sapiens
DHPREHSVCTSKTQTQSAPALQGLSSLLQSVTGNPVPASEAASQSTSASPANTTVSTIKGRNLPSSAQPFIPKSFNYSPNSSTSEVSSTSASKASIGQSPGLPSTTFKLPSNSLGFTATHNTSPAAPPTEVTICQSSEVSKPKLESESTSPSLEMKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGHLSLPQKQYPDSPHPVPHRSLFSPQNTLAAPTGHPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPPPPGEHSGIPFPTPPPPPPPGEHSSSGGSGVPFSTPPPPPPPVDHSGVVPFPAPPLAEHGVAGAVAVFPKDHSSLLQGTLAEHFGVLPGPRDHGGPTQRDLNGPGLSRVRESLTLPSHSLEHLGPPHGGGGGGGSNSSSGPPLGPSHRDTISRSGIILRSPRPDFRPREPFLSRDPFHSLKRPRPPFARGPPFFAPKRPFFPPRY

SEQ ID NO: 868835 - protein, 946 aa, Homo sapiens; identical to SEQ ID NO: 868834

SEQ ID NO: 868836 - protein, 887 aa, Homo sapiens
DHPREHSVCTSKTQTQSAPALQGLSSLLQSVTGNPVPASEAASQSTSASPANTTVSTIKGRNLPSSAQPFIPKSFNYSPNSSTSEVSSTSASKASIGQSPGLPSTTFKLPSNSLGFTATHNTSPAAPPTEVTICQSSEVSKPKLESESTSPSLEMKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGHLSLPQKQYPDSPHPVPHRSLFSPQNTLAAPTGHPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPPPPGEHSGIPFPTPPPPPPPGEHSSSGGSGVPFSTPPPPPPPVDHSGVVPFPAPPLAEHGVAGAVAVFPKDHSSLLQGTLAEHFGVLPGPRDHGGPTQRDLNGPGLSRVRESLTLPSHSLEHLGPPHGGGGGGYFFLLDYTFLKLF

SEQ ID NO: 868837 - protein, 946 aa, Homo sapiens; identical to SEQ ID NO: 868834

SEQ ID NO: 868838 - protein, 321 aa, Homo sapiens
DHPREHSVCTSKTQTQSAPALQGLSSLLQSVTGNPVPASEAASQSTSASPANTTVSTIKGRNLPSSAQPFIPKSFNHSSLPGTDGNRGKGILNSLENIGSRSLVYCCCFYLFSLSRFFFYYNKGPLFQSKKSHTLTFYYSIQSSLPLHLSTFPKLFVLKKKKKKKKKRVKQNKTKGPFFGGGGFGGVGGDKTLFFCPLFLLAHSYFSYLSVNVYDFFPSHAPTVDHPRVCVHPVWGLCTSSGGAVRPFLWRSIAHGRRDISGSRSLCLARIEPDTVSVVTPRRRRHHAFPPGGRLISGEPRRNKPTPRVNICSQGGDETLA

SEQ ID NO: 868839 - protein, 107 aa, Homo sapiens
MSCLFRTKLVWRRFFVQTLAGQGGGSNTAPIPHVAAPSPSPGRLRGVDRPLKGTGCGLCEAPRAAALRGRRSWREVRQVLGRAGSSAGPASPRDCRPGGSASSQRQK

SEQ ID NO: 868840 - protein, 508 aa, Homo sapiens
MPPKRNEKYKLPIPFPEGKVLDDMEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 868841 - protein, 508 aa, Homo sapiens; identical to SEQ ID NO: 868840

SEQ ID NO: 868842 - protein, 390 aa, Homo sapiens
MVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 868843 - protein, 389 aa, Homo sapiens
MPPKRNEKYKLPIPFPEGKVLDDMEGNQWVLGKKIGSGGFGLIYLAFPTNKPEKDARHVVKVVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 868844 - protein, 397 aa, Homo sapiens
MPPKRNEKYKLPIPFPEGKVLDDMEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQVEA

SEQ ID NO: 868845 - protein, 130 aa, Homo sapiens
MPGTPGRPSPRASAPARAESLLPRLVLFSPLGVRTRRPLLLTFAKSGSDVLAEKWVEFLFLPVQRELVAGSWGAGLAVGPRRAKGGRTRRLGRAASRYLPQGQGPRRGWRSAQAHVNPWVPVCSETRVED

SEQ ID NO: 868846 - protein, 508 aa, Homo sapiens; identical to SEQ ID NO: 868840

SEQ ID NO: 868847 - protein, 508 aa, Homo sapiens; identical to SEQ ID NO: 868840

SEQ ID NO: 868848 - protein, 390 aa, Homo sapiens; identical to SEQ ID NO: 868842

SEQ ID NO: 868849 - protein, 339 aa, Homo sapiens
EAEEELGPELGLVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 868850 - protein, 109 aa, Homo sapiens
VPRLCQLVHVEAPGKTVNLCTFKTAIYLLLKSHQSCEQNFFMVEIVPRETRLAIQTFHGDRFQTLIPFPLPRSHGGCGSLSLCRLQIVIPISKNDTENFNVWLNLNREK

SEQ ID NO: 868851 - protein, 525 aa, Homo sapiens
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 868852 - protein, 153 aa, Homo sapiens
ESWNIDLMLKKPFFKDSWGSPASEPLEILVKQVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 868853 - protein, 525 aa, Homo sapiens; identical to SEQ ID NO: 868851

SEQ ID NO: 868854 - protein, 525 aa, Homo sapiens; identical to SEQ ID NO: 868851

SEQ ID NO: 868855 - protein, 262 aa, Homo sapiens
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRARGKSSQADDLGRRAPGPSTGLLAWQSSS

SEQ ID NO: 868856 - protein, 525 aa, Homo sapiens; identical to SEQ ID NO: 868851

SEQ ID NO: 868857 - protein, 525 aa, Homo sapiens; identical to SEQ ID NO: 868851

SEQ ID NO: 868858 - protein, 525 aa, Homo sapiens; identical to SEQ ID NO: 868851

SEQ ID NO: 868859 - protein, 436 aa, Homo sapiens
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITDP

SEQ ID NO: 868860 - protein, 334 aa, Homo sapiens
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRARRFHSSRAMDSKKLGVFYSLSLSGQESTCCTAVHLGRIKKGLYLWLSDHSSPLNMQESPTPRSATLDVFRSSAGRVEAAMQEIQASCFLGNKTYLRIESQ

SEQ ID NO: 868861 - protein, 132 aa, Homo sapiens
ITQGRGCSTRLGLECEEELGPGEWLRNENVNRNFGLNDVTPEQRGWCCKERRDGKVRREVTQENRRWQSQESAAQTSLPGRRAGRSLVGGPPSTSTCTAVSHQDPELSGCSPLTSECPEAQSRAIPAQYPQW

SEQ ID NO: 868862 - protein, 266 aa, Homo sapiens
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGRPSDREEREELQLQPGRGAAASDRRSPVPPSERHGVRPHGENLPGDFQVPQALHRVALSMALPCPMLPAS

SEQ ID NO: 868863 - protein, 439 aa, Homo sapiens
MSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868864 - protein, 109 aa, Homo sapiens
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKENT

SEQ ID NO: 868865 - protein, 137 aa, Homo sapiens
ALTSPHLTQGCGHPQTIPEASQAFKLQHCTALKGYDQRRPFSRFCLEEGPLPLPHPALLSLPHPGLRELPATPGHPALLPVGVSSPEVEDKPLVFNLGGDVYVPFLFWTLSMRQAVLRSPWGEPVCPPSEPTVPIII

SEQ ID NO: 868866 - protein, 137 aa, Homo sapiens; identical to SEQ ID NO: 868865

SEQ ID NO: 868867 - protein, 716 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPGEARPARAQKPAQLKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868868 - protein, 703 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868869 - protein, 627 aa, Homo sapiens
MAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868870 - protein, 137 aa, Homo sapiens; identical to SEQ ID NO: 868865

SEQ ID NO: 868871 - protein, 649 aa, Homo sapiens
MAREHSRRERGNDGVCLFRDRLEQLERKRERERKMREQQKEQREQKERERRAEERRKEREARREVSAHHRTMREDYSDKVKASHWSRSPPRPPRERFELGDGRKPGEARPARAQKPAQLKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868872 - protein, 786 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVRVSMAPPRLAPGGRLFRQGPVLSWGRVLPTLSCTYVEPFTDHTEASICLPGGTGGPYCPSASAPGCRGGWGPGGAQHPQSRALQEIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868873 - protein, 771 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGTAAPRGPVCVQVGAGPGHPRGDSAAGRASCIHRESPEKPLLLPRRAGHPECPGLGAAGSTWEPPSLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868874 - protein, 137 aa, Homo sapiens; identical to SEQ ID NO: 868865

SEQ ID NO: 868875 - protein, 661 aa, Homo sapiens
MAREHSRRERGNDGVCLFRDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVSPPPSGPSQGDPPGPPTAAHLSLQVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868876 - protein, 816 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGGCRSVEEFQCLNRIEEGTYGVVYRAKDKKTDEIVALKRLKMEKEKEGFPITSLREINTILKAQHPNIVTVRVSMAPPRLAPGGRLFRQGPVLSWGRVLPTLSCTYVEPFTDHTEASICLPGGTGGPYCPSASAPGCRGGWGPGGAQHPQSRALQEIVVGSNMDKIYIVMNYVEHDLKSLMETMKQPFLPGTAAPRGPVCVQVGAGPGHPRGDSAAGRASCIHRESPEKPLLLPRRAGHPECPGLGAAGSTWEPPSLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868877 - protein, 137 aa, Homo sapiens; identical to SEQ ID NO: 868865

SEQ ID NO: 868878 - protein, 685 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKPPTASRALAFLNTSPGVLEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868879 - protein, 753 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGTAAPRGPVCVQVGAGPGHPRGDSAAGRASCIHRESPEKPLLLPRRAGHPECPGLGAAGSTWEPPSLPGEVKTLMIQLLRGVKHLHDNWILHRDLKTSNLLLSHAGILKPPTASRALAFLNTSPGVLEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868880 - protein, 676 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLVRD

SEQ ID NO: 868881 - protein, 122 aa, Homo sapiens [sequence omitted]

SEQ ID NO: 868882 - protein, 563 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKNSSTGVALVGHGVLFGECDQKLCSGSQFVHSPGSRLGLGNCR

SEQ ID NO: 868883 - protein, 137 aa, Homo sapiens; identical to SEQ ID NO: 868865

SEQ ID NO: 868884 - protein, 417 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQVRPSPRPGPLSALAVGVTTGAERSLAPVLASVASQGCWAHWGSDGRAQPLAPHASRSRLFLMLDGTGWTGSCPQDCSAA

SEQ ID NO: 868885 - protein, 69 aa, Homo sapiens
SAHHRTMREDYSDKVKASHWSRSPPRPPRERFELGDGRKPGEARPARAQKPAQCESFLGDVWHKCVGFI

SEQ ID NO: 868886 - protein, 133 aa, Homo sapiens
MCPTPLPCRPSSSSRSCPSTCRPCRSGPPLAPGRCPHWQSELPQGLSEAWPPCWRLSPHRAAGPTGAVTGGHSHWPLMLLGPASFSCWTELGGQGAARRTALRLERQPGRAAALLSLLPELRPPPHWRAVPST

SEQ ID NO: 868887 - protein, 703 aa, Homo sapiens; identical to SEQ ID NO: 868868

SEQ ID NO: 868888 - protein, 147 aa, Homo sapiens
DAWVDGRVGRPTRRPRVRAGLELLGSSNPSHSASCSVENIGVGYYTCFSRFYKTADLCVEDRPGVCSLRCEDVLSRDFPRISISFFLLSSKTNRRLGAVAHASNRSTLGGSSWRITRPGVRDQPGQHDETLSLPKIQKLAGCDGGCL

SEQ ID NO: 868889 - protein, 115 aa, Homo sapiens
MILAHCSLDFLGSSDLPPQPPMWLEPQARATMPGYFFVELGSRFVAQAGLELLGSSNPSHSASCSVENIGVGYYTCFSRFYKTADPPLHPHKELPSCLDFLFVDQKQTFFQRISK

SEQ ID NO: 868890 - protein, 137 aa, Homo sapiens; identical to SEQ ID NO: 868865

SEQ ID NO: 868891 - protein, 592 aa, Homo sapiens
IVQLPTTGFDSERTPRGCLHLPYLFSALEGFIVDQSQGPQEGDILLEVHLLVLVPVQVFHQPCNFSILQLLMCENVKSILSGDDNPGFFPFPLPGNPLCKWLLCSLITKDPCHFGIASPQLLLSYWSSFGEMETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868892 - protein, 137 aa, Homo sapiens; identical to SEQ ID NO: 868865

SEQ ID NO: 868893 - protein, 854 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVRVSMAPPRLAPGGRLFRQGPVLSWGRVLPTLSCTYVEPFTDHTEASICLPGGTGGPYCPSASAPGCRGGWGPGGAQHPQSRALQEIVVGSNMDKIYIVMNYVEHDLKSLMETMKQPFLPGTAAPRGPVCVQVGAGPGHPRGDSAAGRASCIHRESPEKPLLLPRRAGHPECPGLGAAGSTWEPPSLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868894 - protein, 769 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKVGLALPQVRYGFQRSCRNGAAGRTGAGLRWGPGPLRALLVACLLSRDTGANTVGHLVWLLKHLFFQDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868895 - protein, 455 aa, Homo sapiens
MPLCLNQVCERTRTLRGTMIELSNIENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868896 - protein, 694 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLVRGLAGGACPQVGLAWAGFSR

SEQ ID NO: 868897 - protein, 768 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVRVSMAPPRLAPGGRLFRQGPVLSWGRVLPTLSCTYVEPFTDHTEASICLPGGTGGPYCPSASAPGCRGGWGPGGAQHPQSRALQEIVVGSNMDKIYIVMNYVEHDLKSLMETMKQPFLPGEVKTLMIQLLRGVKHLHDNWILHRDLKTSNLLLSHAGILKPPTASRALAFLNTSPGVLEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868898 - protein, 137 aa, Homo sapiens; identical to SEQ ID NO: 868865

SEQ ID NO: 868899 - protein, 148 aa, Homo sapiens
GRVGRRTRGSTHASATRRSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 868900 - protein, 424 aa, Homo sapiens
MILWPSNHPSKCLGKKKFITEKMKREKRIRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGTHYGGAVAYA

SEQ ID NO: 868901 - protein, 123 aa, Homo sapiens [sequence omitted]

SEQ ID NO: 868902 - protein, 214 aa, Homo sapiens
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868903 - protein, 271 aa, Homo sapiens
LVRPELRDDNPGPPSSLRRAFRRRELPFPACHEIGLGAEAGSGPPPAPAARESRSRAMEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868904 - protein, 257 aa, Homo sapiens
RTRGSGRVRRELPFPACHEIGLGAEAGSGPPPAPAARESRSRAMEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868905 - protein, 224 aa, Homo sapiens
NLYSCGRSRAMEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868906 - protein, 166 aa, Homo sapiens
MISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868907 - protein, 166 aa, Homo sapiens; identical to SEQ ID NO: 868906

SEQ ID NO: 868908 - protein, 174 aa, Homo sapiens
MAILQLYKTIMLISQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868909 - protein, 214 aa, Homo sapiens; identical to SEQ ID NO: 868902

SEQ ID NO: 868910 - protein, 214 aa, Homo sapiens; identical to SEQ ID NO: 868902

SEQ ID NO: 868911 - protein, 122 aa, Homo sapiens
MAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868912 - protein, 171 aa, Homo sapiens
MEEEASSPGLGCSKPHLEKLTLGITRILESSPGVTEVTIIEKPPAERHMISSWEQKNNCVMPEDVKNFYLMTNGFHMTWSVKLDASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868913 - protein, 166 aa, Homo sapiens; identical to SEQ ID NO: 868906

SEQ ID NO: 868914 - protein, 171 aa, Homo sapiens; identical to SEQ ID NO: 868912

SEQ ID NO: 868915 - protein, 214 aa, Homo sapiens; identical to SEQ ID NO: 868902

SEQ ID NO: 868916 - protein, 170 aa, Homo sapiens
PVRRAKDTVPAPERRGTGAGGARHVRHLETTATRGVAPGPPRLGLQARSPLAAPRRGPPPPARPAPAGREGRGEGEATSRRCGVGHRAGPREPAPHGAAAVRPTPGPHHHCAALSGAENYRSRHAMKLASALRRGPALHPLPPRANRGREPWRRRHRPRGWAAASRTWRS

SEQ ID NO: 868917 - protein, 214 aa, Homo sapiens; identical to SEQ ID NO: 868902

SEQ ID NO: 868918 - protein, 214 aa, Homo sapiens; identical to SEQ ID NO: 868902

SEQ ID NO: 868919 - protein, 166 aa, Homo sapiens; identical to SEQ ID NO: 868906

SEQ ID NO: 868920 - protein, 214 aa, Homo sapiens; identical to SEQ ID NO: 868902

SEQ ID NO: 868921 - protein, 214 aa, Homo sapiens; identical to SEQ ID NO: 868902

SEQ ID NO: 868922 - protein, 214 aa, Homo sapiens; identical to SEQ ID NO: 868902

SEQ ID NO: 868923 - protein, 248 aa, Homo sapiens
MEEEASSPGLGCSKPHLEKLTLGITRILESSPGVTEVTIIEKPPAERHMISSWEQKNNCVMPEDVKNFYLMTNGFHMTWSVKLDVSANKENMELPSLYLHPNHRRLEPSKKTAKFSSLKHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868924 - protein, 181 aa, Homo sapiens
NLYSCGRSRAMEEEASSPGLGCSKPHLEKLTLGITRILESSPGVTEVTIIEKPPAERHMISSWEQKNNCVMPEDVKNFYLMTNGFHMTWSVKLDASDDQPEKPHFDSRSVIFELDSCNGSGKVCLVYKSGKPALAEDTEIWFLDRALYWHFLTDTFTGLLPPAHHPPGPAPVAICLHQLWH

SEQ ID NO: 868925 - protein, 168 aa, Homo sapiens
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPDNL

SEQ ID NO: 868926 - protein, 130 aa, Homo sapiens
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEDNL

SEQ ID NO: 868927 - protein, 339 aa, Homo sapiens
MKNQPFSFCFFRSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 868928 - protein, 333 aa, Homo sapiens
VIDGTVAISWHNWVEFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 868929 - protein, 4365 aa, Homo sapiens
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNICLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTEDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYL

SEQ ID NO: 868930 - protein, 1300 aa, Homo sapiens
FNLIVCLLPSLLHEIQSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 868931 - protein, 329 aa, Homo sapiens
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKILLGTPGVSLLICKGERTDDVSGIILDESLLRAYSVPGAGGHSRVQDSLGPVLREPTFQGERSFLKTSMLRSLCSCSWRHPRSQPCTQASCLQGSDCPAPHRNSTSAAHTLGTS

SEQ ID NO: 868932 - protein, 215 aa, Homo sapiens
MGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKILLGTPGVSLLICKGERTDDVSGIILDESLLRAYSVPGAGGHSRVQDSLGPVLREPTFQGERSFLKTSMLRSLCSCSWRHPRSQPCTQASCLQGSDCPAPHRNSTSAAHTLGTS

SEQ ID NO: 868933 - protein, 440 aa, Homo sapiens
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKGVFSFEAGRRCHSGEGLFAFSTPCAPDLCRAVAGAIARQRERLPELTRPQPCPLPRATSLPSLDTPGELREMPPGPEPPTSRKMHLAEPGPQSLPLLLGPEPNDLASGLYASVCKRASGPPGNEHLYENLCVLEASPTLHGGEPEPHEGPGSRSPTTSPIYHNGQDLSWPGPANDSTLEAQYRRLLELDQVEGTGRPDPQAGFKAKLVTLLSRERRKGPAPCDRP

SEQ ID NO: 868934 - protein, 440 aa, Homo sapiens; identical to SEQ ID NO: 868933

SEQ ID NO: 868935 - protein, 467 aa, Homo sapiens
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKVRCKVGKGEGLTPWTLLLIPTRVPCAQGVFSFEAGRRCHSGEGLFAFSTPCAPDLCRAVAGAIARQRERLPELTRPQPCPLPRATSLPSLDTPGELREMPPGPEPPTSRKMHLAEPGPQSLPLLLGPEPNDLASGLYASVCKRASGPPGNEHLYENLCVLEASPTLHGGEPEPHEGPGSRSPTTSPIYHNGQDLSWPGPANDSTLEAQYRRLLELDQVEGTGRPDPQAGFKAKLVTLLSRERRKGPAPCDRP

SEQ ID NO: 868936 - protein, 329 aa, Homo sapiens; identical to SEQ ID NO: 868931

SEQ ID NO: 868937 - protein, 261 aa, Homo sapiens
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKGVFSFEAGRRCHSGEGLFAFSTPCAPDLCRAVAGAIARQRERLPDA

SEQ ID NO: 868938 - protein, 496 aa, Homo sapiens
MTRGARLRSDARAQLNQLSLDGGTGSGQKGKCEEFPSSLSSVSPGLEAAALLLAVTMDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKGVFSFEAGRRCHSGEGLFAFSTPCAPDLCRAVAGAIARQRERLPELTRPQPCPLPRATSLPSLDTPGELREMPPGPEPPTSRKMHLAEPGPQSLPLLLGPEPNDLASGLYASVCKRASGPPGNEHLYENLCVLEASPTLHGGEPEPHEGPGSRSPTTSPIYHNGQDLSWPGPANDSTLEAQYRRLLELDQVEGTGRPDPQAGFKAKLVTLLSRERRKGPAPCDRP

SEQ ID NO: 868939 - protein, 440 aa, Homo sapiens; identical to SEQ ID NO: 868933

SEQ ID NO: 868940 - protein, 495 aa, Homo sapiens
DSGSQTAIRRACPAEPGLEAAALLLAVTMDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKVRCKVGKGEGLTPWTLLLIPTRVPCAQGVFSFEAGRRCHSGEGLFAFSTPCAPDLCRAVAGAIARQRERLPELTRPQPCPLPRATSLPSLDTPGELREMPPGPEPPTSRKMHLAEPGPQSLPLLLGPEPNDLASGLYASVCKRASGPPGNEHLYENLCVLEASPTLHGGEPEPHEGPGSRSPTTSPIYHNGQDLSWPGPANDSTLEAQYRRLLELDQVEGTGRPDPQAGFKAKLVTLLSRERRKGPAPCDRP

SEQ ID NO: 868941 - protein, 227 aa, Homo sapiens
MDPLETPIKDGILYQQHVKFGKGTGEASSGSTDAQSPKRGLVPMEENSIYSSWQEVGEFPVVVQRTEAATRCQLKGPALLVLGPDAIQLREAKGTQALYSWPYHFLRKFGSDKILLGTPGVSLLICKGERTDDVSGIILDESLLRAYSVPGAGGHSRVQDSLGPVLREPTFQGERSFLKTSMLRSLCSCSWRHPRSQPCTQASCLQGSDCPAPHRNSTSAAHTLGTS

SEQ ID NO: 868942 - protein, 149 aa, Homo sapiens
AGSGFRAFFPRPRPPAGPKVDAQGLEAQRNPLRSVAPLSPVPKDYSAPQRFQCPQSNLSLKYWLSSERVPEDPALLKSEAVSPLIQRIRDSRNESIMEAAGGFQVHFHPSNGDGRFIETSSAADLEVISYSSKVSVTERCFIKVCTVLF

SEQ ID NO: 868943 - protein, 143 aa, Homo sapiens
MWLTPVMPILWEAKEGGSPEARSLRLAWPPWGNCLQKNTKIELGVVAQLLRRLMHENHLNPGGGSCSEPRSCHCIPACATQRDSVSMNEMNECMNEWSEVENSRGGHVTFHYYRNKLSLKQNGNKLSKMICGKYIEIGTIAVS

SEQ ID NO: 868944 - protein, 143 aa, Homo sapiens; identical to SEQ ID NO: 868943

SEQ ID NO: 868945 - protein, 111 aa, Homo sapiens
MVRQVPTLIVLHHLPTLVREHPCRRRSGNTSPTLSMLLLLREQDKMAPDLSHPEVKNNNIRLSSEAIPSLIQVCEHVIVRIDMFRRHFFCGQNHLYSGQHRATEPFLHVTF

SEQ ID NO: 868946 - protein, 111 aa, Homo sapiens; identical to SEQ ID NO: 868945

SEQ ID NO: 868947 - protein, 423 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYG

SEQ ID NO: 868948 - protein, 423 aa, Homo sapiens; identical to SEQ ID NO: 868947

SEQ ID NO: 868949 - protein, 381 aa, Homo sapiens [sequence omitted]

SEQ ID NO: 868950 - protein, 871 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCARSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 868951 - protein, 644 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSGIK

SEQ ID NO: 868952 - protein, 686 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSARLEVSTLNLSLHNPPQQKALVKCTGWGRTLEGKGRLSFSEARSA

SEQ ID NO: 868953 - protein, 668 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSGSRFFKHHHKQQSMRPQNLHHNSILLL

SEQ ID NO: 868954 - protein, 423 aa, Homo sapiens; identical to SEQ ID NO: 868947

SEQ ID NO: 868955 - protein, 339 aa, Homo sapiens [sequence omitted]

SEQ ID NO: 868956 - protein, 320 aa, Homo sapiens
RPPTTTKFAAASTRIPTESGYRYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVVS

SEQ ID NO: 868957 - protein, 424 aa, Homo sapiens
LLVGVSFSSGDFVLNVNKLCDFVGSKTGIYLATGKLLRRSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 868958 - protein, 923 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 868959 - protein, 704 aa, Homo sapiens [sequence omitted]

SEQ ID NO: 868960 - protein, 303 aa, Homo sapiens
MGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 868961 - protein, 609 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEGGTTVLATEKPTVIDSTIQSGIK

SEQ ID NO: 868962 - protein, 551 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKVAPLCWPQKSPRS

SEQ ID NO: 868963 - protein, 632 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGHSFLLATEKPRFIESII

SEQ ID NO: 868964 - protein, 564 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKVRAGDWEEVIPYVLDFNQGPLAFSRG

SEQ ID NO: 868965 - protein, 369 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQDAKYRLRVSVVRSKSSSSSTSLEPRPLSSLKLSFFSYKIKIT

SEQ ID NO: 868966 - protein, 202 aa, Homo sapiens
MTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 868967 - protein, 210 aa, Homo sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSSGPKRYDWTGKNWVYSHDGVSLHELLAAELTKALKTKLDLSSLAYSGKDA

SEQ ID NO: 868968 - protein, 195 aa, Homo sapiens
MRPVATRGRRSTQRWRAERAADPEQHVDSRAPRSSRPPGVTQPGPGPDPHPGPAAGRVGPTLRPPWPAHRHRCDLHAPPRKFEPTWPQPDLECQKAECLFDEFEEIWNFGPPRSGVLTVKLGGDLGTYVINKQTPNKQIWLSSPSSGPKRYDWTGKNWVYSHDGVSLHELLAAELTKALKTKLDLSSLAYSGKDA

SEQ ID NO: 868969 - protein, 210 aa, Homo sapiens; identical to SEQ ID NO: 868967

SEQ ID NO: 868970 - protein, 142 aa, Homo sapiens
IDATCTPRRAVSIRAGNSRGPHAAGRTPHACAGRRRARRGRSGYARWTSSPRSFSGRPGGSGLATPFSGSPGCIYTGFCFPKEKGTFCPAVRLRVKARAKAGQAGGGDRFRGVCGCLHACHFSAITCFSNINRWYLLVYTYT

SEQ ID NO: 868971 - protein, 963 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 868972 - protein, 274 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFGTSCRFVGEKACGLPGPFDRKKFPQLLFPATVGDPLYDME

SEQ ID NO: 868973 - protein, 963 aa, Homo sapiens; identical to SEQ ID NO: 868971

SEQ ID NO: 868974 - protein, 990 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALVKKENIASTLEVSYVPLSIASSSLSRELQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 868975 - protein, 489 aa, Homo sapiens [sequence omitted]

SEQ ID NO: 868976 - protein, 643 aa, Homo sapiens [sequence omitted]

SEQ ID NO: 868977 - protein, 702 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALVKKENIASTLEVSYVPLSIASSSLSRELQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQLPKRRRVENRHPLRWGNPTSVEVAAGPAGEMVRAG

SEQ ID NO: 868978 - protein, 475 aa, Homo sapiens [sequence omitted]

SEQ ID NO: 868979 - protein, 414 aa, Homo sapiens
MGEISSGGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 868980 - protein, 120 aa, Homo sapiens
ILYNSSSYLICSHAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 868981 - protein, 421 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISGADVFVGELLSYLSQVKNRER

SEQ ID NO: 868982 - protein, 325 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARPVAGFLSPFDREQTFDSQLEKVHSLFRRQLAIPLYDMEATFAEYEEWSEDPIPESVIQNYNKALQQHHHSWCCSVGDHTHSS

SEQ ID NO: 868983 - protein, 129 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQVGPGVGSGHLPVFQVLGSPCPGPPP

SEQ ID NO: 868984 - protein, 963 aa, Homo sapiens; identical to SEQ ID NO: 868971

SEQ ID NO: 868985 - protein, 981 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARPVAGFLSPFDREQTFDSQLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 868986 - protein, 932 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALVKKENIASTLEVSYVPLSIASSSLSRELQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGA

SEQ ID NO: 868987 - protein, 412 aa, Homo sapiens
MERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 868988 - protein, 284 aa, Homo sapiens
MGRIWTTSLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 868989 - protein, 438 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQGI

SEQ ID NO: 868990 - protein, 201 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICKFPWTFFGYLAMSYISVCC

SEQ ID NO: 868991 - protein, 412 aa, Homo sapiens
REQVRRGEEAAVLLTRSALLPLSAYLYPPACSATRTPSTMTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQGPYYCGVGADRAYGRDIVEAHYRACLYAGVKIAGTNAEVMPAQWEFQIGPCEGISMGDHLWVARFILHRVCEDFGVIATFDPKPIPGNWNGAGCHTNFSTKAMREENGLKYIEEAIEKLSKRHQYHIRAYDPKGGLDNARRLTGFHETSNINDFSAGVANRSASIRIPRTVGQEKKGYFEDRRPSANCDPFSVTEALIRTCLLNETGDEPFQYKN

SEQ ID NO: 868992 - protein, 253 aa, Homo sapiens [sequence omitted]

SEQ ID NO: 868993 - protein, 176 aa, Homo sapiens [sequence omitted]

SEQ ID NO: 868994 - protein, 151 aa, Homo sapiens
REQVRRGEEAAVLLTRSALLPLSAYLYPPACSATRTPSTMTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAGVL

SEQ ID NO: 868995 - protein, 176 aa, Homo sapiens [sequence omitted]

SEQ ID NO: 868996 - protein, 248 aa, Homo sapiens
REQVRRGEEAAVLLTRSALLPLSAYLYPPACSATRTPSTMTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQGPYYCGVGADRAYGRDIVEAHYRACLYAGVKIAGTNAEVMPAQVSIAPIHQ

SEQ ID NO: 868997 - protein, 412 aa, Homo sapiens; identical to SEQ ID NO: 868991

SEQ ID NO: 868998 - protein, 412 aa, Homo sapiens; identical to SEQ ID NO: 868991

SEQ ID NO: 868999 - protein, 412 aa, Homo sapiens; identical to SEQ ID NO: 868991

SEQ ID NO: 869000 - protein, 412 aa, Homo sapiens; identical to SEQ ID NO: 868991

SEQ ID NO: 869001 - protein, 412 aa, Homo sapiens; identical to SEQ ID NO: 868991

SEQ ID NO: 869002 - protein, 412 aa, Homo sapiens; identical to SEQ ID NO: 868991

SEQ ID NO: 869003 - protein, 215 aa, Homo sapiens
REQVRRGEEAAVLLTRSALLPLSAYLYPPACSAKRGSSPSRKSTKKATNENYEDNEKSDSSGSRSSCFGFVAYSVNSGERSRVKIKTLTHQPACSDTPRAGRCLSPSPSPSPRKLRCLDQLESEKEERRERHSKKRRVKEGNPNDTLDFLWLGTPSSTKIKWTRPPAVEPLLVLHPTPTLPPLPVVPIVTQRVEYQGRFFHSMCPVNLAFFVWLG

SEQ ID NO: 869004 - protein, 412 aa, Homo sapiens; identical to SEQ ID NO: 868991

SEQ ID NO: 869005 - protein, 445 aa, Homo sapiens
REQVRRGEEAAVLLTRSALLPLSAYLYPPACSATRTPSTMTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQGPYYCGVGADRAYGRDIVEAHYRACLYAGVKIAGTNAEVMPAQWEFQIGPCEGISMGDHLWVARFILHRVCEDFGVIATFDPKPIPGNWNGAGCHTNFSTKAMREENGLKYIEEAIEKLSKRHQYHIRAYDPKGGLDNARRLTGFHETSNINDFSAGVANRSASIRIPRTVGQEKKGYFEDRRPSANCDPFSVTEALIRTCLLNETGDEPPTLPPLPVVPIVTQRVEYQGRFFHSMCPVNLAFFVWLG

SEQ ID NO: 869006 - protein, 445 aa, Homo sapiens; identical to SEQ ID NO: 869005

SEQ ID NO: 869007 - protein, 112 aa, Homo sapiens
MTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAGVL

SEQ ID NO: 869008 - protein, 307 aa, Homo sapiens
REQVRRGEEAAVLLTRSALLPLSAYLYPPACSATRTPSTMTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQGPYYCGVGADRAYGRDIVEAHYRACLYAGVKIAGTNAEVMPAQWEFQIGPCEGISMGDHLWVARFILHRVCEDFGVIATFDPKPIPGNWNGAGCHTNFSTKAMREENGLK

SEQ ID NO: 869009 - protein, 412 aa, Homo sapiens; identical to SEQ ID NO: 868991

SEQ ID NO: 869010 - protein, 445 aa, Homo sapiens; identical to SEQ ID NO: 869005

SEQ ID NO: 869011 - protein, 412 aa, Homo sapiens; identical to SEQ ID NO: 868991

SEQ ID NO: 869012 - protein, 412 aa, Homo sapiens; identical to SEQ ID NO: 868991

SEQ ID NO: 869013 - protein, 209 aa, Homo sapiens
REQVRRGEEAAVLLTRSALLPLSAYLYPPACSATRTPSTMTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQLQLFPLSQLSRL

SEQ ID NO: 869014 - protein, 412 aa, Homo sapiens; identical to SEQ ID NO: 868991

SEQ ID NO: 869015 - protein, 248 aa, Homo sapiens; identical to SEQ ID NO: 868996

SEQ ID NO: 869016 - protein, 469 aa, Homo sapiens [sequence omitted]

SEQ ID NO: 869017 - protein, 281 aa, Homo sapiens
MAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869018 - protein, 489 aa, Homo sapiens
ILTYTHSTSTLAVSRCWEAMMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869019 - protein, 469 aa, Homo sapiens [sequence omitted]

SEQ ID NO: 869020 - protein, 469 aa, Homo sapiens [sequence omitted]

SEQ ID NO: 869021 - protein, 444 aa, Homo sapiens
FSSLPLEPPRFPAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869022 - protein, 456 aa, Homo sapiens
DQEFTVKSKGAGGQGKVASKIVGPSGAAVPCKVEPGLGADNSVVRFLPREEGPYEVEVTYDGVPVPGSPFPLEAVAPTKPSKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869023 - protein, 281 aa, Homo sapiens; identical to SEQ ID NO: 869017

SEQ ID NO: 869024 - protein, 299 aa, Homo sapiens
DLEDLGMRNVTLHSQLWSDGTQEDLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869025 - protein, 229 aa, Homo sapiens
FLLFCFVLFCFKAPLTHPPLSFGFWILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869026 - protein, 168 aa, Homo sapiens
RLVEAGLNRPRERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869027 - protein, 274 aa, Homo sapiens
MAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRGSCRGQGYR

SEQ ID NO: 869028 - protein, 469 aa, Homo sapiens [sequence omitted]

SEQ ID NO: 869029 - protein, 489 aa, Homo sapiens
GPNIVYVRPRGILAEVYEAMMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869030 - protein, 469 aa, Homo sapiens [sequence omitted]

SEQ ID NO: 869031 - protein, 469 aa, Homo sapiens [sequence omitted]

SEQ ID NO: 869032 - protein, 469 aa, Homo sapiens [sequence omitted]

SEQ ID NO: 869033 - protein, 469 aa, Homo sapiens [sequence omitted]

SEQ ID NO: 869034 - protein, 466 aa, Homo sapiens
MWTVRVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869035 - protein, 394 aa, Homo sapiens
QHPPPPNMARIRPWLRWREELSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869036 - protein, 129 aa, Homo sapiens [sequence omitted]

SEQ ID NO: 869037 - protein, 309 aa, Homo sapiens
MPRLALAGFEFACACLVHDAQLLVLNGTHGIGPSRWQSDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 869038 - protein, 129 aa, Homo sapiens [sequence omitted]

SEQ ID NO: 869039 - protein, 108 aa, Homo sapiens
MDLQDPCIGDGGSREVKVRESRGSPQPPSPWQMMLQDFQIQAFNVMGEQFSYASDCASFFSPGIWMGLLTSLFMLFIFTYGLHMILSLKTMDRFDDHKGPTISLTQIV

SEQ ID NO: 869040 - protein, 346 aa, Homo sapiens
MAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENSPEPKPPTTSDMNHPAGMQDSGQAARLRSKAILENCRCHAPDHKCSLPPSSMRNAFLCSQPDGKQIAIAAYPVATGSRPSCDKRSIAQLEQTTAGFAERWLTVRKKPLLSGNSIAIASDPNPAVVPERIRDHLEPSKGSLGRKAPQGMAQEKPKYPARPCQTKAGQFAFAAAIGNSMTLGYSKFLLAAAPEHPRKSRASNFLASLCSLIVAFLSQLAEESHKHLL

SEQ ID NO: 869041 - protein, 126 aa, Homo sapiens
RPPTITTARIQASNDVTGTWPHPTPLLPQNQSHLPASLGRAGRSQTPSWPTGPLSGSVGPWALDKHWGTCPQSHPLLIPNPVSLPPDAADSGCGLHVFMQYSLPDASPASGPWGLGCRRVVGEGGS

SEQ ID NO: 869042 - protein, 902 aa, Homo sapiens
PHPGGGALAVTRRTAAAAAEAPVPSARTLRSPEQLLEGNRGAAPGIRLGPLALLCGEGAGPPAGPEPSGSAPSPVPPPRRLLWLLWGFAGAGDPRSGRHAGIAAADQRMTFGLGGPPWVQGGGPPGLGGPRGLGWQFFPVVGAFSTPENARSFKAVHLGVGRMPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEGVHYSHLELSPGEPVQEGDPHFRSALTAHPVRDPVHMYQLHKAFARAELERTYQEIQELQWEIQNTSHLAVDGDRAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 869043 - protein, 749 aa, Homo sapiens
MRASLLLSVLRPAGPVAVGISLGFTLSLLSVTWVEEPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIGVHYSHLELSPGEPVQEGDPHFRSALTAHPVRDPVHMYQLHKAFARAELERTYQEIQELQWEIQNTSHLAVDGDRAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 869044 - protein, 775 aa, Homo sapiens
MRASLLLSVLRPAGPVAVGISLGFTLSLLSVTWVEEPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEGVHYSHLELSPGEPVQEGDPHFRSALTAHPVRDPVHMYQLHKAFARAELERTYQEIQELQWEIQNTSHLAVDGDRAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 869045 - protein, 510 aa, Homo sapiens
MPLVFIDATGVYLMPLVFIDATGVGCTGDHEGVHYSHLELSPGEPVQEGDPHFRSALTAHPVRDPVHMYQLHKAFARAELERTYQEIQELQWEIQNTSHLAVDGDRAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 869046 - protein, 775 aa, Homo sapiens; identical to SEQ ID NO: 869044

SEQ ID NO: 869047 - protein, 423 aa, Homo sapiens
MPIPERKTTAPRPDRWNGCSAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 869048 - protein, 775 aa, Homo sapiens; identical to SEQ ID NO: 869044

SEQ ID NO: 869049 - protein, 292 aa, Homo sapiens
AKYEAWVLNRPRILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 869050 - protein, 188 aa, Homo sapiens
AGHTVPAGASWRSRSMRHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 869051 - protein, 775 aa, Homo sapiens; identical to SEQ ID NO: 869044

SEQ ID NO: 869052 - protein, 775 aa, Homo sapiens; identical to SEQ ID NO: 869044

SEQ ID NO: 869053 - protein, 543 aa, Homo sapiens
LVKWACVLSQSCPRAKIITNINAYYVQGSLIFSNPCNNPENNYFHWHNGRQCQLITDPFPSSPQGVHYSHLELSPGEPVQEGDPHFRSALTAHPVRDPVHMYQLHKAFARAELERTYQEIQELQWEIQNTSHLAVDGDRAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 869054 - protein, 775 aa, Homo sapiens; identical to SEQ ID NO: 869044

SEQ ID NO: 869055 - protein, 434 aa, Homo sapiens
LLRVHGTRPEIQELQWEIQNTSHLAVDGDRAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 869056 - protein, 775 aa, Homo sapiens; identical to SEQ ID NO: 869044

SEQ ID NO: 869057 - protein, 298 aa, Homo sapiens
MRASLLLSVLRPAGPVAVGISLGFTLSLLSVTWVEEPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEVG

SEQ ID NO: 869058 - protein, 801 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869059 - protein, 801 aa, Homo sapiens; identical to SEQ ID NO: 869058

SEQ ID NO: 869060 - protein, 801 aa, Homo sapiens; identical to SEQ ID NO: 869058

SEQ ID NO: 869061 - protein, 615 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKL

SEQ ID NO: 869062 - protein, 801 aa, Homo sapiens; identical to SEQ ID NO: 869058

SEQ ID NO: 869063 - protein, 433 aa, Homo sapiens
MGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKSGN

SEQ ID NO: 869064 - protein, 801 aa, Homo sapiens; identical to SEQ ID NO: 869058

SEQ ID NO: 869065 - protein, 801 aa, Homo sapiens; identical to SEQ ID NO: 869058

SEQ ID NO: 869066 - protein, 788 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSS

SEQ ID NO: 869067 - protein, 714 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRLY

SEQ ID NO: 869068 - protein, 801 aa, Homo sapiens; identical to SEQ ID NO: 869058

SEQ ID NO: 869069 - protein, 804 aa, Homo sapiens
MAAPMNGQVCVVTGASRGIGRGIALQLCKAGATVYITGRHLDTLRVVAQEAQSLGGQCVPVVCDSTPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869070 - protein, 754 aa, Homo sapiens
MASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869071 - protein, 754 aa, Homo sapiens; identical to SEQ ID NO: 869070

SEQ ID NO: 869072 - protein, 632 aa, Homo sapiens
ENLYLEFETVGWGFVLRKILSIIKNNPKKGAQVAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869073 - protein, 545 aa, Homo sapiens
HEDLRKVAVLHLLMPALAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869074 - protein, 399 aa, Homo sapiens [sequence omitted]

SEQ ID NO: 869075 - protein, 384 aa, Homo sapiens
LERPPTTTKFAAASTHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869076 - protein, 377 aa, Homo sapiens
LSDELRISLGMSVGPNAHKVPPPWLIAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869077 - protein, 256 aa, Homo sapiens
MLLREEKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869078 - protein, 220 aa, Homo sapiens
WVDRGLWVDRGLWVDRGLWVDRGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869079 - protein, 163 aa, Homo sapiens
NGMCWLAADVQEGNLGTLGAHNKMLGAILMYPDKFLSLAIKKPVGKTKEELALEKKRELEKRLQDVSGQLNSTKKPPKKGEYILSCHYRLTPSCLLDCLLLTNEDSDLNVFNFRICSAANEKTESSSAQQVAVSRLSASSSSSDSSSSSSSSSSSDTSDSDSG

SEQ ID NO: 869080 - protein, 55 aa, Homo sapiens
MPDEPLEPGPLPVSTAMPPGLAKSSSESSSEESSSESSSEEEEEEDEEDEEEEES

SEQ ID NO: 869081 - protein, 801 aa, Homo sapiens; identical to SEQ ID NO: 869058

SEQ ID NO: 869082 - protein, 813 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKFFFFFFFEMESRFVAQAGVQWRDLSSLQAPPLGFTPFSCLSLLSSWDYRRPPPRPAWDLFYHEYSQPPYNVRLPHIHTYEAGCIAMLLQDSCKSGFVLRESTWACVPLKGPVSIAGVHACSEGMSPCEECSSAWGAERGGRQVLSEPHTFLCKLVNIRRSQCIVPVATEIPSARSSAMISRIFGLKAFAVLGSHVFRSKHKNSSTGKESLAAGAARPLRAADRMAERWPRAQDLALRTPRPGAASAKASALPRA

SEQ ID NO: 869083 - protein, 801 aa, Homo sapiens; identical to SEQ ID NO: 869058

SEQ ID NO: 869084 - protein, 840 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKGEYILSCHYRLTPSCLLDCLLLTNEDSDLNVFNFRICSAANEKTESSSAQQVAVSRLSASSSSSDSSSSSSSSSSSDTSDSDSG

SEQ ID NO: 869085 - protein, 679 aa, Homo sapiens
MGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869086 - protein, 555 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKSGN

SEQ ID NO: 869087 - protein, 416 aa, Homo sapiens [sequence omitted]

SEQ ID NO: 869088 - protein, 862 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKTEIFLQPTQIPLTSNLNPRAQILKVIPTVLSREGSSCGVWGWQGKVSLPACAASDAGLLLQRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869089 - protein, 786 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQPFRYLNGCELVGHYVLSCR

SEQ ID NO: 869090 - protein, 722 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYGPFSPLFMVTSMFPIVRRPT

SEQ ID NO: 869091 - protein, 616 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKVS

SEQ ID NO: 869092 - protein, 803 aa, Homo sapiens
IRPLGVQQPGARLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869093 - protein, 573 aa, Homo sapiens
TRGLGHPAHLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869094 - protein, 548 aa, Homo sapiens
CVLEILFTLLLLLSSPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869095 - protein, 364 aa, Homo sapiens [sequence omitted]

SEQ ID NO: 869096 - protein, 350 aa, Homo sapiens
RLYSTGRLYSTGRLYSTDRLYSTGRLYESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869097 - protein, 381 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPCFEIVCSNLF

SEQ ID NO: 869098 - protein, 200 aa, Homo sapiens [sequence omitted]

SEQ ID NO: 869099 - protein, 222 aa, Homo sapiens
MGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKGQANGVSPPIALKKRELVSPIQGPQGKRTLAFGFL

SEQ ID NO: 869100 - protein, 124 aa, Homo sapiens
NGMCWLAADVQEGNLGTLGAHNKMLGAILMYPDKFLSLAIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 869101 - protein, 417 aa, Homo sapiens
MRSLLLGTLCLLAVALAAEVKKPVEAAAPGTAEKLSSKATTLAEPSTGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFPDKRSALQSINEWAAQTTDGKLPEVTKDVERTDGALLVNAMFFKPHWDEKFHHKMVDNRGFMVTRSYTVGVTMMHRTGLYNYYDDEKEKLQLVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 869102 - protein, 118 aa, Homo sapiens
VTGSEAWVAVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 869103 - protein, 118 aa, Homo sapiens; identical to SEQ ID NO: 869102

SEQ ID NO: 869104 - protein, 116 aa, Homo sapiens
MRLCGGYDGLNGRLYYAPPELGRSFNMEVVPFVPWAPLDGMRKFVIRAPPGNTIFCALGNTRFSAQTYLPCWAKYPALGEVQTKWAWLCFSKIINYFVNKYKNRWLAGFGHGAIVC

SEQ ID NO: 869105 - protein, 130 aa, Homo sapiens
THFCFLKGSISQGNYGLVCWGWGLGRGYYMVLYLQQELVSRSRKTSSVLLLKPAPAALLFSWYDFHLLLSLDFSLLGLVLRISLELISSSDFIYLLLRWITSSSSCVGFKRWYHAREHEDDSLQHACPLT

SEQ ID NO: 869106 - protein, 600 aa, Homo sapiens
MQQESERCRVRARRPDMALYVPKARRGAVLLKTGDEEESCGSPNSVVKEKQKESSLSQKEVFKDKPEARRLNINPDRKEHNCREEKKSSTKLRMDTCLQKTNRVCSKRGTTESKEVLSQGQQQGAPNAGVITNAPLQRHFKPKKVECLEVETTDVTGHERILLSQACLEISEAQVPSKPFQNVEFCDFSRHEPDGEAFEDKDLEGRIETDTKVLEILYEFPRVFSSVMKPENMIVPIKLSSDSEIVQQSMQTSDGILNPSSGGITTTSVPGSPDGVFDQTCVDFEVESVGGIANSTGFILDQKDTDSIPATMGHISLSESTNDTVSPVMIRECEKNDSTADELHVKHEPPDTAVLAHETHRDSGFKNVGDITNKACMMDTTGMSCSDHVTVDSPYVVAVRIADETSINTRSFSKFVGMSADATPLHVARSGNDTEDFSNPSACSDIYGESISSHFTESTGKLIESLSDCASSLPIKKIAGSNYNTFLDSELSMLNGTKVLSDSAVGIDLGSTGDTTEALHELRTAEEFKTEEQDDSGSIEFGVSFPDRESSSMETSIEPKATETSHTEGITAIEESWESMFNDDGDCLDPRLLQEALVSG

SEQ ID NO: 869107 - protein, 600 aa, Homo sapiens; identical to SEQ ID NO: 869106

SEQ ID NO: 869108 - protein, 600 aa, Homo sapiens; identical to SEQ ID NO: 869106

SEQ ID NO: 869109 - protein, 600 aa, Homo sapiens; identical to SEQ ID NO: 869106

SEQ ID NO: 869110 - protein, 229 aa, Homo sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQILLRAFEARDRNIQESNFDRVNFWSMVNLVVMVVVSAIQVYMLKSLFEDKRKSRT

SEQ ID NO: 869111 - protein, 229 aa, Homo sapiens; identical to SEQ ID NO: 869110

SEQ ID NO: 869112 - protein, 162 aa, Homo sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILVSMVF

SEQ ID NO: 869113 - protein, 229 aa, Homo sapiens; identical to SEQ ID NO: 869110

SEQ ID NO: 869114 - protein, 120 aa, Homo sapiens [sequence omitted]

SEQ ID NO: 869115 - protein, 125 aa, Homo sapiens [sequence omitted]

SEQ ID NO: 869116 - protein, 124 aa, Homo sapiens
RRLAWPLRKDDTQIREASIFLDNMGEQAQEQEDWKKYITGTDILDMKLEDILESINSIKSRLSKSGHIQILLRAFEARDRNIQESNFDRVNFWSMVNLVVMVVVSAIQVYMLKSLFEDKRKSRT

SEQ ID NO: 869117 - protein, 162 aa, Homo sapiens; identical to SEQ ID NO: 869112

SEQ ID NO: 869118 - protein, 193 aa, Homo sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILDPIIKIASDVQIRLHLGIHQQHQVQTKQKWAHTNSA

SEQ ID NO: 869119 - protein, 253 aa, Homo sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTCIRSKNGPGTAVHAYNPSTFRGRSVETEVGDYMFCFDNTFSTISEKVIFFELILDNMGEQAQEQEDWKKYITGTDILDMKLEDILESINSIKSRLSKSGHIQILLRAFEARDRNIQESNFDRVNFWSMVNLVVMVVVSAIQVYMLKSLFEDKRKSRT

SEQ ID NO: 869120 - protein, 178 aa, Homo sapiens
MPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQILLRAFEARDRNIQESNFDRVNFWSMVNLVVMVVVSAIQVYMLKSLFEDKRKSRT

SEQ ID NO: 869121 - protein, 125 aa, Homo sapiens [sequence omitted]

SEQ ID NO: 869122 - protein, 105 aa, Homo sapiens
GTRITPDPERWLPMRERSYYRGRKKGKKKDQIGKGTQGATAGASSEVDASKTVSSPPTSPRPGSAATVSASTSNIIPPRHQKPAGAPATKKKQQQKKKKGGKGGW

SEQ ID NO: 869123 - protein, 546 aa, Homo sapiens
CLFPVAVVARAMATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAELASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 869124 - protein, 413 aa, Homo sapiens
CLFPVAVVARAMATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAELASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVRYRGGGYSNR

SEQ ID NO: 869125 - protein, 211 aa, Homo sapiens
LLTDCVGLFLSPVQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 869126 - protein, 123 aa, Homo sapiens
SDLLLVIIWETNQKKTKLVSFPLPLTFFMTYLNFGRFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 869127 - protein, 143 aa, Homo sapiens [sequence omitted]

SEQ ID NO: 869128 - protein, 546 aa, Homo sapiens; identical to SEQ ID NO: 869123

SEQ ID NO: 869129 - protein, 559 aa, Homo sapiens
CLFPVAVVARAMATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAEVNQGFLLDLDPLLLASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 869130 - protein, 120 aa, Homo sapiens
SKKALTKSLGLLRTCTRLPNSRLQRRLLDPGQAASTQRGTVAAAAPAGWRADTSRRKATRLPWWESMGDVAFLPGEKVSLQSLETRWREAPLPGTRRLLLRPGSARRLPGVPRALFPTRC

SEQ ID NO: 869131 - protein, 262 aa, Homo sapiens
MNLLPCNPHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYWLQLPSGCVPHLGIQGTGIFIGENGIFI

SEQ ID NO: 869132 - protein, 344 aa, Homo sapiens
MNLLPCNPHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 869133 - protein, 379 aa, Homo sapiens
MNLLPCNPHGNGLLYAGFNQDHDALRVGWKMDSGAMNLLPCNPHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 869134 - protein, 344 aa, Homo sapiens; identical to SEQ ID NO: 869132

SEQ ID NO: 869135 - protein, 377 aa, Homo sapiens
MNLLPCNPHGNGLLYAGFNQDHGCFACGMENGFRVYNTDPLKEKEKQEFLEGGVGHVEMLFRCNYLALVGGGKKPKYPPNKGTEKMKWEEIIGRKNSGRQGLRSWPLSGSVISQVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 869136 - protein, 226 aa, Homo sapiens
MIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 869137 - protein, 344 aa, Homo sapiens; identical to SEQ ID NO: 869132

SEQ ID NO: 869138 - protein, 344 aa, Homo sapiens; identical to SEQ ID NO: 869132

SEQ ID NO: 869139 - protein, 344 aa, Homo sapiens; identical to SEQ ID NO: 869132

SEQ ID NO: 869140 - protein, 344 aa, Homo sapiens; identical to SEQ ID NO: 869132

SEQ ID NO: 869141 - protein, 238 aa, Homo sapiens
MNLLPCNPHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGTLVSKPYVVVCFPKDSHFQY

SEQ ID NO: 869142 - protein, 287 aa, Homo sapiens
MNLLPCNPHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYWHSTFNQGWRSSIWGNPGDHGTSGIFLARRRSQKALTRPVGAQPGSFQILSGP

SEQ ID NO: 869143 - protein, 287 aa, Homo sapiens; identical to SEQ ID NO: 869142

SEQ ID NO: 869144 - protein, 344 aa, Homo sapiens; identical to SEQ ID NO: 869132

SEQ ID NO: 869145 - protein, 208 aa, Homo sapiens
MNLLPCNPHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGI

SEQ ID NO: 869146 - protein, 344 aa, Homo sapiens; identical to SEQ ID NO: 869132

SEQ ID NO: 869147 - protein, 174 aa, Homo sapiens
MNLLPCNPHGNGLLYAGFNQDHGCFACGMENGFRVYNTDPLKEKEKQVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGI

SEQ ID NO: 869148 - protein, 186 aa, Homo sapiens
RLCSSSGHAHGPCHCDHRAPDDIPAHEGVLSCIALNLQGTRIATASEKGTLIRIFDTSSGHLIQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 869149 - protein, 344 aa, Homo sapiens; identical to SEQ ID NO: 869132

SEQ ID NO: 869150 - protein, 344 aa, Homo sapiens; identical to SEQ ID NO: 869132

SEQ ID NO: 869151 - protein, 114 aa, Homo sapiens
MNLLPCNPHGNGLLYAGFNQDHGCFACGMENGFRVYNTDPLKEKEKQEFLEGGVGHVEMLFRCNYLALVGGGKKPKYPPNKVMIWDDLKKKVAQKKKISQKYLKKQKLMALFVL

SEQ ID NO: 869152 - protein, 89 aa, Homo sapiens
APPLISFPMQLLEHSPRIHQHSPVPTLAQPGMNLLFATHGLLGAGVGGCLPTLCRRVFSPSGRAENGGIDWSRQCSCQSTERHGWGRAW

SEQ ID NO: 869153 - protein, 128 aa, Homo sapiens
MGNILTCCINSHCGWPRGKDAPCYESDTDIYETVAAATSESTTVEPGKLDVGATEGQDLQHISNQKMPTGKKATGAVYPLAHLWPPPPPSLTLIPRDILSFQLPPVHSQLSQVWAWGTKADSASCLCR

SEQ ID NO: 869154 - protein, 166 aa, Homo sapiens
MGNILTCCINSHCGWPRGKDAPCYESDTDIYETVAAATSESTTVEPGKLDVGATEGQDLQHISNQKMPTGPPEDRLSLKFLPSSEEDNDDAKIFLCVLPGSSEDNLSLVCLPRSEDDDCDDDDDDDAQILPSRVQGGCYRFDSSSCLLRTTELVCLPRSEDDDCDD

SEQ ID NO: 869155 - protein, 118 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVIYFFT

SEQ ID NO: 869156 - protein, 117 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVSKYR

SEQ ID NO: 869157 - protein, 117 aa, Homo sapiens; identical to SEQ ID NO: 869156

SEQ ID NO: 869158 - protein, 116 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVRRD

SEQ ID NO: 869159 - protein, 188 aa, Homo sapiens
LWAQIPVCSPVCSVKAEWVRWGGRVSPEHPASRLQEYETSVFTLLVPQFYNCKIGHYLEYWDILCVSNSSAARPRGSRREAELGSSVHFSRSVPRRVSRRSLRRGTDPHSLCQKNVVDIIRVNVDKVLERDQKLSELDDRADALQAGASQFESSAAKLKRKYWWKNCKMMIMLGAICAIIVVVIVRRD

SEQ ID NO: 869160 - protein, 286 aa, Homo sapiens
MNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTPFTCVSWMLLKAGWSESLFWKLNQWLMIHMFHCRMVLTYHMWWVCFWHWDGLVSSLYLPHLTLFLVGLALLTLIINPYWTHKKTQQLLNPVDWNFAQPEAKSRPEGNGQLLRKKRP

SEQ ID NO: 869161 - protein, 286 aa, Homo sapiens; identical to SEQ ID NO: 869160

SEQ ID NO: 869162 - protein, 286 aa, Homo sapiens; identical to SEQ ID NO: 869160

SEQ ID NO: 869163 - protein, 211 aa, Homo sapiens
ASCTQLAVFQFSLCGRYFHKSADFWDAGQGCDFPGFLWSEISVEWRGVCWRKRPWPVLRIAYSSHLETPDFRSHSAVAENKVLERKAEALTHIDALNINTTSMSQVAGWSESLFWKLNQWLMIHMFHCRMVLTYHMWWVCFWHWDGLVSSLYLPHLTLFLVGLALLTLIINPYWTHKKTQQLLNPVDWNFAQPEAKSRPEGNGQLLRKKRP

SEQ ID NO: 869164 - protein, 128 aa, Homo sapiens
LQETGSLERKNKHNNITPAFGVEAGWSESLFWKLNQWLMIHMFHCRMVLTYHMWWVCFWHWDGLVSSLYLPHLTLFLVGLALLTLIINPYWTHKKTQQLLNPVDWNFAQPEAKSRPEGNGQLLRKKRP

SEQ ID NO: 869165 - protein, 286 aa, Homo sapiens; identical to SEQ ID NO: 869160

SEQ ID NO: 869166 - protein, 286 aa, Homo sapiens; identical to SEQ ID NO: 869160

SEQ ID NO: 869167 - protein, 342 aa, Homo sapiens
LFQGHWTLRPAQSKMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 869168 - protein, 502 aa, Homo sapiens [sequence omitted]

SEQ ID NO: 869169 - protein, 105 aa, Homo sapiens
MLHFKLELPLQSTEHVLGVQLILTFSYRLHRMATLVMQSMAFLQSSFPVPGSQLYVNGDLRLQQKQPLSCGGLDARYNVRALLIVQLLCFCVLLFVEFFEEGDKK

SEQ ID NO: 869170 - protein, 502 aa, Homo sapiens [sequence omitted]

SEQ ID NO: 869171 - protein, 502 aa, Homo sapiens [sequence omitted]

SEQ ID NO: 869172 - protein, 728 aa, Homo sapiens
MWTADEIAQLCYEHYGIRLPKKGKPEPNHEWTLLAAVVKIQSPADKACDTPDKPVQVTKEVVSMGTGTKCIGQSKMRKNGDILNDSHAEVIARRSFQRYLLHQLQLAATLKEDSIFVPGTQKGVWKLRRDLIFVFFSSHTPCGDASIIPMLEFEDQPCCPVFRNWANNSSVEASSNLEAPGNERKCEDPDSPVTKKMRLEPGTAAREVTNGAAHHQSFGKQKSGPISPGIHSCDLTVEGLATVTRIAPGSAKVIDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRMQGTSGHTPSGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 869173 - protein, 336 aa, Homo sapiens
GNQEKPNLVPRLAECLRAVLMALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 869174 - protein, 200 aa, Homo sapiens
MLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 869175 - protein, 158 aa, Homo sapiens
GNQEKPNLVPRLAECLRAVLMALYELFSHPVERSYRAGLCSKAALFLLLAAALTYIPPLLVAFRSHGEPAPAAVPRGSPGALGQAGLPNRLPTALFNSGFWLKRSSYEEQPTVRFQHQVLLVALLGPESDGFLAWSTFPAFNRLQGDRLRVPLVSWRR

SEQ ID NO: 869176 - protein, 558 aa, Homo sapiens
MWTADEIAQLCYEHYGIRLPKKGKPEPNHEWTLLAAVVKIQSPADKACDTPDKPVQVTKEVVSMGTGTKCIGQSKMRKNGDILNDSHAEVIARRSFQRYLLHQLQLAATLKEDSIFVPGTQKGVWKLRRDLIFVFFSSHTPCGDASIIPMLEFEDQPCCPVFRNWANNSSVEASSNLEAPGNERKCEDPDSPVTKKMRLEPGTAAREVTNGAAHHQSFGKQKSGPISPGIHSCDLTVEGLATVTRIAPGSAKVIDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRVLAEAEQLRGAADRALPTPGAARGPARTRKRRVPRLEHVPRLQPAARGSPARPARFVGEIMPLSFVYSRTVGSLCMYRSDVDSSPDSLVTRAAGPVWVS

SEQ ID NO: 869177 - protein, 728 aa, Homo sapiens; identical to SEQ ID NO: 869172

SEQ ID NO: 869178 - protein, 126 aa, Homo sapiens
GNQEKPNLVPRLAECLRAVLMALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSWRR

SEQ ID NO: 869179 - protein, 105 aa, Homo sapiens; identical to SEQ ID NO: 869169

SEQ ID NO: 869180 - protein, 259 aa, Homo sapiens
GNQEKPNLVPRLAECLRAVLMALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNGESQVEPIQPLLRTFKVD

SEQ ID NO: 869181 - protein, 502 aa, Homo sapiens [sequence omitted]

SEQ ID NO: 869182 - protein, 521 aa, Homo sapiens
MWTADEIAQLCYEHYGIRLPKKGKPEPNHEWTLLAAVVKIQSPADKACDTPDKPVQVTKEVVSMGTGTKCIGQSKMRKNGTRPSPASICLHLVSIFAAGDILNDSHAEVIARRSFQRYLLHQLQLAATLKEDSIFVPGTQKGVWKLRRDLIFVFFSSHTPCGDASIIPMLEFEDQPCCPVFRNWANNSSVEASSNLEAPGNERKCEDPDSPVTKKMRLEPGTAAREVTNGAAHHQSFGKQKSGPISPGIHSCDLTVEGLATVTRIAPGSAKVIDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRVQKLDTYQEYKEAASSYQEAWSTLRKQVFGSWIRNPPDYHQFK

SEQ ID NO: 869183 - protein, 728 aa, Homo sapiens; identical to SEQ ID NO: 869172

SEQ ID NO: 869184 - protein, 200 aa, Homo sapiens; identical to SEQ ID NO: 869174

SEQ ID NO: 869185 - protein, 483 aa, Homo sapiens
HSVRRGTRPDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 869186 - protein, 677 aa, Homo sapiens
MWTADEIAQLCYEHYGIRLPKKGKPEPNHEWTLLAAVVKIQSPADKACDTPDKPVQVTKEVVSMGTGTKCIGQSKMRKNGDILNDSHAEVIARRSFQRYLLHQLQLAATLKEDSIFVPGTQKGVWKLRRDLIFVFFSSHTPCGDASIIPMLEFEDQPCCPVFRNWANNSSVEASSNLEAPGNERKCEDPDSPVTKKMRLEPGTAAREVTNGAAHHQSFGKQKSGPISPGIHSCDLTVEGLATVTRIAPGSAKVIDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRVLAEAEQLRGAADRALPTPGAARGPARTRKRRVPRLEHVPRLQPAARGSPARPARFVGEIMPLSFVYSRTVGSLCMYRSDVDSSPDSLVTRAAGPVWVSQTREEDRNQDGKTDMLHFKLELPLQSTEHVLGVQLILTFSYRLHRMATLVMQSMAFLQSSFPVPGSQLYVNGDLRLQQKQPLSCGGLDARYNVRALLIVQLLCFCVLLFVEFFEEGDKK

SEQ ID NO: 869187 - protein, 158 aa, Homo sapiens
GNQEKPNLVPRLAECLRAVLMALYELFSHPVERSYRAGLCSKAALFLLLAAALTYIPPLLVAFRSHGEPAPAAVPRGSPGALGQAGLPNRLPTALFNSGFWLKRSSYEEQPTVRFQHQVLLVALLGPESDGFLAWSTFPAFNRLQGDRLRVPLVSWGR

SEQ ID NO: 869188 - protein, 495 aa, Homo sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 869189 - protein, 482 aa, Homo sapiens
MLLLGLLLLLPLLAGARLLWNWWKLRSLHLPPLAPGFLHLLQPDLPIYLLGLTQKFGPIYRLHLGLQDVVVLNSKRTIEEAMVKNKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 869190 - protein, 495 aa, Homo sapiens; identical to SEQ ID NO: 869188

SEQ ID NO: 869191 - protein, 522 aa, Homo sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSDSRGLGMSEESPSQGGPGQPLTPAPFSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 869192 - protein, 139 aa, Homo sapiens
EFNSDCRAEIRTTRSSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 869193 - protein, 495 aa, Homo sapiens; identical to SEQ ID NO: 869188

SEQ ID NO: 869194 - protein, 495 aa, Homo sapiens; identical to SEQ ID NO: 869188

SEQ ID NO: 869195 - protein, 495 aa, Homo sapiens; identical to SEQ ID NO: 869188

SEQ ID NO: 869196 - protein, 495 aa, Homo sapiens; identical to SEQ ID NO: 869188

SEQ ID NO: 869197 - protein, 495 aa, Homo sapiens; identical to SEQ ID NO: 869188

SEQ ID NO: 869198 - protein, 156 aa, Homo sapiens
MLWSPWKFPGGAKCLGFVFQQLKDDAVALVDVIAPPDFVLDSPIGRADGEVKGGQGLTGVPQGLMGISAELRCSCGSGVWCLLESGHTWRSFLGRARDKSGLSHSGASPCWLCGCRGLAHPLPAFSSRDGVVALPACTGRGWRSTHCDLCPPASAF

SEQ ID NO: 869199 - protein, 700 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 869200 - protein, 700 aa, Homo sapiens; identical to SEQ ID NO: 869199

SEQ ID NO: 869201 - protein, 700 aa, Homo sapiens; identical to SEQ ID NO: 869199

SEQ ID NO: 869202 - protein, 490 aa, Homo sapiens
MELCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 869203 - protein, 226 aa, Homo sapiens
MKTTWYLQDAGSALSLGGVVTNAVFSIVTFSPSVCHSEVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 869204 - protein, 246 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGTLQKPLGRCPAGKQGVGAGILVARVFCEQTCHRKSEIEALVGLAHIQPSLMKRRELIRRGPQLLIPEHAGDCCCFLSPHLCA

SEQ ID NO: 869205 - protein, 700 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGSFLGGFSQMAGTHASLVLGYTAYPFMSCVSGLVKNKILPTPRASVYPLEGGADPVEALTVLRCTKEGTQVSAREGGHRAGAPLLPEKNPK

SEQ ID NO: 869206 - protein, 126 aa, Homo sapiens
HAVVFAKLCVPGDQCHGLHPFIVQVGRWGGPQWGQCLPPGSTGNVWSHFCHNKGGACFWHLVSGPGTLPRTPVHPIAPPTVQTAPPTVHSTALPTMQIAPSTVHPTTLPTVHRQPRPQCTDSSAHS

SEQ ID NO: 869207 - protein, 624 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRAERRCSCPGRRDRSS

SEQ ID NO: 869208 - protein, 683 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHGEALLHQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 869209 - protein, 724 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLKDDAVALVDVIAPPDFVLDSPIGRADGEILVARVFCEQTCHRKSEIEALVGLAHIQPSLMKRRELIRRGPQLLIPEHAGDCCCFLSPHLCA

SEQ ID NO: 869210 - protein, 667 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLNCPGGREGGTRPAGLIWDRGDLQRGKEMQMIMST

SEQ ID NO: 869211 - protein, 353 aa, Homo sapiens [sequence omitted]

SEQ ID NO: 869212 - protein, 647 aa, Homo sapiens
IVTRGVCVAEEAGGTVYPQRGTMPGTKRFQHVIETPEPGKWELSGYEAAVPITEKSNPLTQDLDKADAENIVRLLGQCDAEIFQEEGQALSTYQRLYSESILTTMVQVAGKVQEVLKEPDGGLVVLSGGGTSGRMAFLMSVSFNQLMKGLGQKPLYTYLIAGGDRSVVASREGTEDSALHGIEELKKVAAGKKRVIVIGISVGLSAPFVAGQMDCCMNNTAVFLPVLVGFNPVSMARNDPIEDWSSTFRQVAERMQKMQEKQKAFVLNPAIGPEGLSGSSRMKGGSATKILLETLLLAAHKTVDQGIAASQRCLLEILRTFERAHQVTYSQSPKIATLMKSVSTSLEKKGHVYLVGWQTLGIIAIMDGVECIHTFGADFRDVRGFLIGDHSDMFNQKAELTNQGPQFTFSQEDFLTSILPSLTEIDTVVFIFTLDDNLTEVQTIVEQVKEKTNHIQALAHSTVGQTLPIPLKKLFPSIISITWPLLFFEYEGNFIQKFQRELSTKWVLNTVSTGAHVLLGKILQNHMLDLRISNSKLFWRALAMLQRFSGQSKARCIESLLRAIHFPQPLSDDIRAAPISCHVQVAHEKEQVIPIALLSLLFRCSITEAQAHLAAAPSVCEAVRSALAGPGQKRTADPLEILEPDVQ

SEQ ID NO: 869213 - protein, 631 aa, Homo sapiens
IVTRGVCVAEEAGGTVYPQRGTMPGTKRFQHVIETPEPGKWELSGYEAAVPITEKSNPLTQDLDKADAENIVRLLGQCDAEIFQEEGQALSTYQRLYSESILTTMVQVAGKVQEVLKEPDGGLVVLSGGGTSGRMAFLMSVSFNQLMKGLGQKPLYTYLIAGGDRSVVASREGTEDSALHGIEELKKVAAGKKRVIVIGISVGLSAPFVAGQMDCCMNNTAVFLPVLVGFNPVSMARNDPIEDWSSTFRQVAERMQPEGLSGSSRMKGGSATKILLETLLLAAHKTVDQGIAASQRCLLEILRTFERAHQVTYSQSPKIATLMKSVSTSLEKKGHVYLVGWQTLGIIAIMDGVECIHTFGADFRDVRGFLIGDHSDMFNQKAELTNQGPQFTFSQEDFLTSILPSLTEIDTVVFIFTLDDNLTEVQTIVEQVKEKTNHIQALAHSTVGQTLPIPLKKLFPSIISITWPLLFFEYEGNFIQKFQRELSTKWVLNTVSTGAHVLLGKILQNHMLDLRISNSKLFWRALAMLQRFSGQSKARCIESLLRAIHFPQPLSDDIRAAPISCHVQVAHEKEQVIPIALLSLLFRCSITEAQAHLAAAPSVCEAVRSALAGPGQKRTADPLEILEPDVQ

SEQ ID NO: 869214 - protein, 277 aa, Homo sapiens
IVTRGVCVAEEAGGTVYPQRGTMPGTKRFQHVIETPEPGKWELSGYEAAVPITEKSNPLTQDLDKADAENIVRLLGQCDAEIFQEEGQALSTYQRLYSESILTTMVQVAGKVQEVLKEPDGGLVVLSGGGTSGRMAFLMSVSFNQLMKGLGQKPLYTYLIAGGDRSVVASREGTEDSALHGIEELKKVAAGKKRVIVIGISVGLSAPFVAGQMDCCMNNTAVFLPVLVGFNPVSMARHPFPPPRILRSLTVFPSLRAPHYQITSLLFSMSVVTLISE

SEQ ID NO: 869215 - protein, 261 aa, Homo sapiens
MCTVFSWEGPSHLLLPQGPQFTFSQEDFLTSILPSLTEIDTVVFIFTLDDNLTEVQTIVEQVKEKTNHIQALAHSTVGQTLPIPLKKLFPSIISITWPLLFFEYEGNFIQKFQRELSTKWVLNTVSTGAHVLLGKILQNHMLDLRISNSKLFWRALAMLQRFSGQSKARCIESLLRAIHFPQPLSDDIRAAPISCHVQVAHEKEQVIPIALLSLLFRCSITEAQAHLAAAPSVCEAVRSALAGPGQKRTADPLEILEPDVQ

SEQ ID NO: 869216 - protein, 106 aa, Homo sapiens
LLHSSLFLLFCFLPIEEALAAPSERSLGLLSAPLQGPAEFSSKGAVPSPPRSGRHLSFLRGNWALLESWCFSPRCLLEILRTFERAHQVTYSQSPKIATLMKSVST

SEQ ID NO: 869217 - protein, 236 aa, Homo sapiens
GAGSRKEGHMSKHDGPFMRGNLLKCTAITCSPSPDVIKNGRLGALFPPALAEKPGFRLVKLEVGCGNWLGVIGDERDIEDIMKPVNSTPEKDTAEREKRWNKKAYLIGLVWVRRTEESESAARARGYGKHCPPTLHLGETQKRTSFICKKGKQLRQWGWLKGTLQCADAFHFFHLPCLSKNPYGPGLRTELSAEMKIYGSVFQNDEEFQDGGSGKILLQEKSVLGPMCKHLLRNLE

SEQ ID NO: 869218 - protein, 240 aa, Homo sapiens
GAGSRKEGHMSKHDGPFMRGNLLKCTAITCSPSPDVIKNGRLGALFPPALAEKPGFRLVKLEVGCGNWLGVIGDERDIEDIMKPVNSTPEKDTAEREKRWNKKAYLIGLVWVRRTEESESAARARGYGKHCPPTLHLGETQKRTSFICKKGKQLRQWGWLKGTLQCADAFHFFHLPCLSKNPYGPGLRTELSAEMKIYGSVFQNDEEFQDGGSGKILLQEKSVLGPMCKHLLSETTSGCI

SEQ ID NO: 869219 - protein, 244 aa, Homo sapiens
GAGSRKEGHMSKHDGPFMRGNLLKCTAITCSPSPDVIKNGRLGALFPPALAEKPGFRLVKLEVGCGNWLGVIGDERDIEDIMKPVNSTPEKDTAEREKRWNKKAYLIGLVWVRRTEESESAARARGYGKHCPPTLHLGETQKRTSFICKKGKQLRQWGWLKGTLQCADAFHFFHLPCLSKNPYGPGLRTELSAEMKIYGSVFQNDEEFQDGGSGKILLQEKSVLGPMCKHLLSIVKPATCSQFF

SEQ ID NO: 869220 - protein, 244 aa, Homo sapiens; identical to SEQ ID NO: 869219

SEQ ID NO: 869221 - protein, 190 aa, Homo sapiens
QSKANQKHRAQQLLWLCRQTWQCGRAAQTIREKPGVDQAPRCLRPWCNSAGDWGTLEQSFTRMGNPHSWVALPPGQARWQSVRAAGCCPQPSWSIFLRCVHCFIFKILFFTGKERKPLLRDTRYRASRGCSPAPPGRGADFSFRVDGAKSLCKMYAWWLLPASLMTKCISIPVKTCITMYLKLLSLCSIV

SEQ ID NO: 869222 - protein, 133 aa, Homo sapiens
RNRGTRRLSNLLKVTQLSCSEPHPLLRTSWAVSHPNLATTQKGLFFREWKQPTGPGLECVSHLGAPEGTYTAVLVCATRGQPPHIDLYCFRELSKPAGLRERNLVQGREREEPTAVRASDLPRVHPECVKSSS

SEQ ID NO: 869223 - protein, 153 aa, Homo sapiens
YKLTAVLTLGPLLQGMEAADWTGIGVCVRLVEGVGGGGLRQLAFFGGSLSWHLGGHQAVARAGGLQVPGTEATPCCGLQLALFSTSQLPPGGARGHIYCCTRLCHQRAASAHRSLLLPRTVQTGGTEREKPGPGQRKRGAHCSACKRSSTRPS

SEQ ID NO: 869224 - protein, 434 aa, Homo sapiens
HLVLINAEADSSPPSAPQAGAERRRALGSLRRGQGAVPGWAGYVSRYCGSRRRPRPRGSSRVRGRRAVRPGPRASRGRAGGAQGPRSPASPPSSRAQPRLGSLPLALVAMASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGDGWSICCICSKREAKEFSETS

SEQ ID NO: 869225 - protein, 577 aa, Homo sapiens
HLVLINAEADSSPPSAPQAGAERRRALGSLRRGQGAVPGWAGYVSRYCGSRRRPRPRGSSRVRGRRAVRPGPRASRGRAGGAQGPRSPASPPSSRAQPRLGSLPLALVAMASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPGAVLPLALGLAITALLLLMVACRLRLVKQKLKKARPITSEESDYLINGMYL

SEQ ID NO: 869226 - protein, 609 aa, Homo sapiens
HLVLINAEADSSPPSAPQAGAERRRALGSLRRGQGAVPGWAGYVSRYCGSRRRPRPRGSSRVRGRRAVRPGPRASRGRAGGAQGPRSPASPPSSRAQPRLGSLPLALVAMASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETGAVLPLALGLAITALLLLMVACRLRLVKQKLKKARPITSEESDYLINGMYL

SEQ ID NO: 869227 - protein, 609 aa, Homo sapiens; identical to SEQ ID NO: 869226

SEQ ID NO: 869228 - protein, 409 aa, Homo sapiens
HLVLINAEADSSPPSAPQAGAERRRALGSLRRGQGAVPGWAGYVSRYCGSRRRPRPRGSSRVRGRRAVRPGPRASRGRAGGAQGPRSPASPPSSRAQPRLGSLPLALVAMASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKMQGVTPWWKSLRKPLPQTSHLHYQTQRRGIIPPFGDQRVKSFL

SEQ ID NO: 869229 - protein, 609 aa, Homo sapiens; identical to SEQ ID NO: 869226

SEQ ID NO: 869230 - protein, 345 aa, Homo sapiens
HLVLINAEADSSPPSAPQAGAERRRALGSLRRGQGAVPGWAGYVSRYCGSRRRPRPRGSSRVRGRRAVRPGPRASRGRAGGAQGPRSPASPPSSRAQPRLGSLPLALVAMASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQGASIRNPEAVPPTGGNLHLPADRDGHCRAEKL

SEQ ID NO: 869231 - protein, 609 aa, Homo sapiens; identical to SEQ ID NO: 869226

SEQ ID NO: 869232 - protein, 95 aa, Homo sapiens
SFMNYLFSFSEKDAPPLSKAGQDVVLHLPTDGVVLDGRESTDDHAIVQYEWALLQGDPSVDMKLAARSAGAHRACEGGRPACGAPARGSCPGLLG

SEQ ID NO: 869233 - protein, 609 aa, Homo sapiens; identical to SEQ ID NO: 869226

SEQ ID NO: 869234 - protein, 609 aa, Homo sapiens; identical to SEQ ID NO: 869226

SEQ ID NO: 869235 - protein, 556 aa, Homo sapiens
HLVLINAEADSSPPSAPQAGAERRRALGSLRRGQGAVPGWAGYVSRYCGSRRRPRPRGSSRVRGRRAVRPGPRASRGRAGGAQGPRSPASPPSSRAQPRLGSLPLALVAMASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYSSTARRAAATSASSRCTAATAATASAARRTAPPWPPRAPRPGRVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETGAVLPLALGLAITALLLLMVACRLRLVKQKLKKARPITSEESDYLINGMYL

SEQ ID NO: 869236 - protein, 584 aa, Homo sapiens
HLVLINAEADSSPPSAPQAGAERRRALGSLRRGQGAVPGWAGYVSRYCGSRRRPRPRGSSRVRGRRAVRPGPRASRGRAGGAQGPRSPASPPSSRAQPRLGSLPLALVAMASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETGKCPPWKPFADCSLLRTACPLAEDIP

SEQ ID NO: 869237 - protein, 309 aa, Homo sapiens
MFSPADNIFIILITGEFILGILGNGYIALVNWIDWIKKKKISTVDYILTNLVIARICLISVMVVNGIVIVLNPDVYTKNKQQIVIFTFWTFANYLNMWITTCLNVFYFLKIASSSHPLFLWLKWKIDMVVHWILLGCFAISLLVSLIAAIVLSCDYRFHAIAKHKRNITEMFHVSKIPYFEPLTLFNLFAIVPFIVSLISFFLLVRSLWRHTKQIKLYATGSRDPSTEVHVRAIKTMTSFIFFFFLYYISSILMTFSYLMTKYKLAVEFGEIAAILYPLGHSLILIVLNNKLRQTFVRMLTCRKIACMI

SEQ ID NO: 869238 - protein, 105 aa, Homo sapiens
SRCSGWPSLFCVLLLLEAQPLWRCDLVIGRFTAKTPGSPGSLEMGPLTFMDVAIEFSLEEWQCLDTAQRNVYRHVMLENYRNLVFLARPDYLSGTRKRALEYEET

SEQ ID NO: 869239 - protein, 146 aa, Homo sapiens
SRCSVWPSLFCVLLLLEAQPLWRCDLVIGRFTAKTPGSPGSLEMGPLTFMDVAIEFSLEEWQCLDTAQRNVYRHVMLENYRNLVFLALCSRFAQDLWLEQNIKDSFHKSDTEQIWKIWTYDLQLEDKAVHSVDECHGNTKAGYNGT

SEQ ID NO: 869240 - protein, 190 aa, Homo sapiens [sequence omitted]

SEQ ID NO: 869241 - protein, 437 aa, Homo sapiens
QRPGSDLWRLLQSRQEEGGSPQSKASESSSSFSSSSSSSSSRPGSPATRQTPPSTAPGAGPSRRQGPSTLRPEPRSRGFRSPRGGGLAAVQVKLQMALELMRKELEDALTQEANVGKKTVIWKEKVEMQRQRFRLEFEKHRGFLAQEEQRQLRRLEAEERATLQRLRESKSRLVQQSKALKELADELQERCQRPALGLLEGVRGVLSRSKAVTRLEAENIPMELKTACCIPGRRELLRKFQVDVKLDPATAHPSLLLTADLRSVQDGEPWRDVPNNPERFDTWPCILGLQSFSSGRHYWEVLVGEGAEWGLGVCQDTLPRKGETTPSPENGVWALWLLKGNEYMVLASPSVPLLQLESPRCIGIFLDYEAGEISFYNVTDGSYIYTFNQLFSGLLRPYFFICDATPLILPPTTIAGSGNWASRDHLDPASDVRDDHL

SEQ ID NO: 869242 - protein, 193 aa, Homo sapiens
HHILSAVDVKLDPATAHPSLLLTADLRSVQDGEPWRDVPNNPERFDTWPCILGLQSFSSGRHYWEVLVGEGAEWGLGVCQDTLPRKGETTPSPENGVWALWLLKGNEYMVLASPSVPLLQLESPRCIGIFLDYEAGEISFYNVTDGSYIYTFNQLFSGLLRPYFFICDATPLILPPTTIAGSGNWASRDHLDP

SEQ ID NO: 869243 - protein, 888 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKREKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRWVHIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRYPS

SEQ ID NO: 869244 - protein, 878 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKREKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEDGFIIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTERVPRERRQRQSVLQKKPKAEDLRTECATCKGTGDNENLVRCDECRLCYHFGCLDPPLKKSPKQTGYGWICQECDSSSSKEDENEAERKNISQELNMEQKNPKK

SEQ ID NO: 869245 - protein, 697 aa, Homo sapiens
WCWGDSPDLRRCSEGGCKKKKSKVLSRNSADDEELTNDSLTLSQSKSNEDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRWVHIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRCDECRLCYHFGCLDPPLKKSPKQTGYGWICQECDSSSSKEDENEAERKNISQELNMEQKNPKK

SEQ ID NO: 869246 - protein, 895 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKREKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEDGFIIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRCDECRLCYHFGCLDPPLKKSPKQTGYGWICQECDSSSSKEDENEAERKNISQELNMEQKNPKK

SEQ ID NO: 869247 - protein, 895 aa, Homo sapiens; identical to SEQ ID NO: 869246

SEQ ID NO: 869248 - protein, 895 aa, Homo sapiens; identical to SEQ ID NO: 869246

SEQ ID NO: 869249 - protein, 835 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKREKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEDGFIIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRYPS

SEQ ID NO: 869250 - protein, 839 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKREKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEDGFIIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRHNANQKS

SEQ ID NO: 869251 - protein, 871 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKREKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEDGFIIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRCDECRLCYHFGCLDPPLKKSPKQTGYGWICQECDSSSSK

SEQ ID NO: 869252 - protein, 410 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKREKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRRLPSRVGD

SEQ ID NO: 869253 - protein, 895 aa, Homo sapiens; identical to SEQ ID NO: 869246

SEQ ID NO: 869254 - protein, 663 aa, Homo sapiens
MIVQMTVILKLEMPQDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRWVHIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRCDECRLCYHFGCLDPPLKKSPKQTGYGWICQECDSSSSKEDENEAERKNISQELNMEQKNPKK

SEQ ID NO: 869255 - protein, 895 aa, Homo sapiens; identical to SEQ ID NO: 869246

SEQ ID NO: 869256 - protein, 895 aa, Homo sapiens; identical to SEQ ID NO: 869246

SEQ ID NO: 869257 - protein, 205 aa, Homo sapiens
RHTLMGTGTPTSGADPLLQGARKTKQLLQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRCDECRLCYHFGCLDPPLKKSPKQTGYGWICQECDSSSSKEDENEAERKNISQELNMEQKNPKK

SEQ ID NO: 869258 - protein, 833 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKREKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEDGFIIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRK

SEQ ID NO: 869259 - protein, 361 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKREKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEDGFILFVPCMFLE

SEQ ID NO: 869260 - protein, 333 aa, Homo sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 869261 - protein, 124 aa, Homo sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSGKFLPGSWEPWAHPDHVASYSLPSTAPVPKF

SEQ ID NO: 869262 - protein, 333 aa, Homo sapiens; identical to SEQ ID NO: 869260

SEQ ID NO: 869263 - protein, 333 aa, Homo sapiens; identical to SEQ ID NO: 869260

SEQ ID NO: 869264 - protein, 333 aa, Homo sapiens; identical to SEQ ID NO: 869260

SEQ ID NO: 869265 - protein, 339 aa, Homo sapiens
MVSKSRWKLLAMLALVLVVMVWYSISREDRYIELFYFPIPEKKEPCLQGEAESKASKLFGKLSPLCSYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 869266 - protein, 301 aa, Homo sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 869267 - protein, 375 aa, Homo sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQDAEFGQSRSCQSSAEWQLNPGRSLPVLRKACNCVFTMLFQDSQGRYNFPQQERGTSEVCTAWLATQVLAKVTVGLLARPPPAVPGALTMRSGGGVLRMKHLIWPFSPWRACWVWVLEMMGGPVEKQRPIRHPGRARPCWRPLGWVQKCIH

SEQ ID NO: 869268 - protein, 437 aa, Homo sapiens
SDPLRSLGVSKRDSSAESFRPQSPQPLRPGLKRRPPPPASSSDGFSHNYPGQVQHLGADCAGGDRLCGVRLCAGVSKVAEQDPKVARGSRDDSSPQESCCLLRNMVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 869269 - protein, 333 aa, Homo sapiens; identical to SEQ ID NO: 869260

SEQ ID NO: 869270 - protein, 333 aa, Homo sapiens; identical to SEQ ID NO: 869260

SEQ ID NO: 869271 - protein, 333 aa, Homo sapiens; identical to SEQ ID NO: 869260

SEQ ID NO: 869272 - protein, 356 aa, Homo sapiens
MELVARGSRDDSSPQESCCLLRNMVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 869273 - protein, 275 aa, Homo sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQMENVSVTAGSSTAERWQR

SEQ ID NO: 869274 - protein, 407 aa, Homo sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQDAEFGQSRSCQSSAEWQLNPGRSLPVLRKACNCVFTMLFQDSQGRYNFPQQERGTSEVCTAWLATQVLAKVTVGLLARPPPAVPGALTMRSGGGVLRMKHLIWPFSPWRACWVWVLEMMGGPVEKQRPIRHPGRARPCWRPLGWVQKCIH

SEQ ID NO: 869275 - protein, 316 aa, Homo sapiens
RKSRGGSKETRSPRLMAMLVLVPGRVMRPLGGQLWRFLPRGLEFWGPAEGTARVLLRQFCARQAEAWRASGRPGYCLGTRPLSTARPPPPWSQKGPGDSTRPSKPGPVSWKSLAITFAIGGALLAGMKHVKKEKAEKLEKERQRHIGKPLLGGPFSLTTHTGERKTDKDYLGQWLLIYFGFTHCPDVCPEELEKMIQVVDEIDSITTLPDLTPLFISIDPERDTKEAIANYVKEFSPKLVGLTGTREEVDQVARAYRVYYSPGPKDEDEDYIVDHTIIMYLIGPDGEFLDYFGQNKRKGEIAASIATHMRPYRKKS

SEQ ID NO: 869276 - protein, 316 aa, Homo sapiens; identical to SEQ ID NO: 869275

SEQ ID NO: 869277 - protein, 232 aa, Homo sapiens
HATPPPPRPPPPPPADYRYGMSPVSWKSLAITFAIGGALLAGMKHVKKEKAEKLEKERQRHIGKPLLGGPFSLTTHTGERKTDKDYLGQWLLIYFGFTHCPDVCPEELEKMIQVVDEIDSITTLPDLTPLFISIDPERDTKEAIANYVKEFSPKLVGLTGTREEVDQVARAYRVYYSPGPKDEDEDYIVDHTIIMYLIGPDGEFLDYFGQNKRKGEIAASIATHMRPYRKKS

SEQ ID NO: 869278 - protein, 316 aa, Homo sapiens; identical to SEQ ID NO: 869275

SEQ ID NO: 869279 - protein, 298 aa, Homo sapiens
RKSRGGSKETRSPRLMAMLVLVPGRVMRPLGGQLWRFLPRGLEFWGPAEGTARVLLRQFCARQAEAWRASGRPGYCLGTRPLSTARPPPPWSQKGPGDSTRPSKPGPVSWKSLAITFAIGGALLAGMKHVKKEKAEKLEKERQRHIGKPLLGGPFSLTTHTGEPHCPDVCPEELEKMIQVVDEIDSITTLPDLTPLFISIDPERDTKEAIANYVKEFSPKLVGLTGTREEVDQVARAYRVYYSPGPKDEDEDYIVDHTIIMYLIGPDGEFLDYFGQNKRKGEIAASIATHMRPYRKKS

SEQ ID NO: 869280 - protein, 226 aa, Homo sapiens
MQVLQCAAGGNVNVEMNAAPGVDLTVLLNNMRAEYEALAEQNRRDAEAWFNEKSASLQQQISEDVGATTSARNELTEMKRTLQTLEIELQSLLATKHSLECSLTETESNYCAQLAQIQAQIGALEEQLHQVRTETEGQKLEYEQLLDIKLHLEKEIETYCLLIGGDDGACKSGGYKSKDYGSGNVGSQVKDPAKAIVVKKVLEEVDQRSKILTTRLHSLEEKSQSN

SEQ ID NO: 869281 - protein, 121 aa, Homo sapiens
AIWEVEEEQEEEKETTRPVMVSRAYGGGGSGGGEKKEERKETEQKELEEEEVEEEEGKEMEQQEEGKEMEEEEQEENEMEEEEEEKEMEEEKETGGGKRNGGGRGGGGQRNSQAGRGGSPL

SEQ ID NO: 869282 - protein, 138 aa, Homo sapiens
MNVSLEKQLRPSQPWPRGKCRKTPGWEEARPKAQDLRGDLGKTQAGPAEAHTRGPPRLPAATGCPPHLPGLLSGISVDIDPTGLQSQWTPKGQDPPLMFSEDYQKSLLEQYHLGLDQKLRKYVVGELIWNFADFMTNQ

SEQ ID NO: 869283 - protein, 123 aa, Homo sapiens
MNVSLEKQLRPSQPWPRGKCRKTPGWEEARPKAQDLRGDLGKTQAGPAEAHTRGPPRLPAATGCPPHLPGLLSGISVDIDPTGLQSQWTPKGQRWGLSILPRPVVNSWVQAIHPPRPLEVLGL

SEQ ID NO: 869284 - protein, 54 aa, Homo sapiens
MWQTCFTLSGLLWELIRTMGDWAEVFLLQRGSWTGARCWPWGFQSKHNSVKHVF

SEQ ID NO: 869285 - protein, 121 aa, Homo sapiens; identical to SEQ ID NO: 869281

SEQ ID NO: 869286 - protein, 183 aa, Homo sapiens
MNVSLEKQLRPSQPWPRGKCRKTPGWEEARPKAQDLRGDLGKTQAGPAEAHTRGPPRLPAATGCPPHLPGLLSGISVDIDPTGLQSQWTPKGQDPPLMFSEDYQKSLLEQYHLGLDQKLRKYVVGELIWNFADFMTNQCKRQFGSWDNVPVLIFSGCLAHSGHLDCKNIGNKARSWFNPCRLR

SEQ ID NO: 869287 - protein, 140 aa, Homo sapiens
MNVSLEKQLRPSQPWPRGKCRKTPGWEEARPKAQDLRGDLGKTQAGPAEAHTRGPPRLPAATGCPPHLPGLLSGISVDIDPTGLQSQWTPKGQDPPLMFSEDYQKSLLEQYHLGLDQKLRKYVVGELIWNFADFMTNQCG

SEQ ID NO: 869288 - protein, 430 aa, Homo sapiens
MATLSVKPSRRFQLPDWHTNSYLLSTNAQLQRDASHQIRQEARVLRNETNNQTIWDEHDNRTRLVERIDTVNRWKEMLDKCLTDLDAEIDALTQMKESAEQNLQAKNLPLDVAIECLTLRESRRDIDVVKDPVEDELHKEVEVIEATKKALQQKVSQAFEQLCLLQEVQQQLNSDHRGKMETLEIDRGCLSLNLRSPNISLKVDPTRVPDGSTTLQQWDDFSRFNKDRAEAEMKAATELREATALTIAETNNELEAQRVATEFAFRKRLREMEKVYSELKWQEKNTLEEIAELQEDIRHLEEDLRTKLLSLKLSHTRLEARTYRPNVELCRDQAQYGLTDEVHQLEATIAALKQKLAQAQDALDALCKHLARLQADIACKANSMLLDTKCMDTRRKLTVPAERFVPEVDTFTRTTNSTLSPLKSCQLELA

SEQ ID NO: 869289 - protein, 474 aa, Homo sapiens
MATLSVKPSRRFQLPDWHTNSYLLSTNAQLQRDASHQIRQEARVLRNETNNQTIWDEHDNRTRLVERIDTVNRWKEMLDKCLTDLDAEIDALTQRRGFTIFGQAVLELLTSSVPSNSASRSAGITDVSHRARPRPLFQMKESAEQNLQAKNLPLDVAIECLTLRESRRDIDVVKDPVEDELHKEVEVIEATKKALQQKVSQAFEQLCLLQEVQQQLNSDHRGKMETLEIDRGCLSLNLRSPNISLKVDPTRVPDGSTTLQQWDDFSRFNKDRAEAEMKAATELREATALTIAETNNELEAQRVATEFAFRKRLREMEKVYSELKWQEKNTLEEIAELQEDIRHLEEDLRTKLLSLKLSHTRLEARTYRPNVELCRDQAQYGLTDEVHQLEATIAALKQKLAQAQDALDALCKHLARLQADIACKANSMLLDTKCMDTRRKLTVPAERFVPEVDTFTRTTNSTLSPLKSCQLELA

SEQ ID NO: 869290 - protein, 392 aa, Homo sapiens
MATLSVKPSRRFQLPDWHTNSYLLSTNAQLQRDASHQIRQEARVLRNETNNQTIWDEHDNRTRLVERIDTVNRWKEMLDKCLTDLDAEIDALTQMKESAEQNLQAKNLPLDVAIECLTLRESRRDIDVVKDPVEDELHKEVEVIEATKKALQQKVSQAFEQLCLLQEVQQQLNSDHRGKMETLEIDRGCLSLNLRSPNISLKVDPTRVPDGTNNELEAQRVATEFAFRKRLREMEKVYSELKWQEKNTLEEIAELQEDIRHLEEDLRTKLLSLKLSHTRLEARTYRPNVELCRDQAQYGLTDEVHQLEATIAALKQKLAQAQDALDALCKHLARLQADIACKANSMLLDTKCMDTRRKLTVPAERFVPEVDTFTRTTNSTLSPLKSCQLELA

SEQ ID NO: 869291 - protein, 326 aa, Homo sapiens
MFFIHKRVHIGQTFGKYNEYEKACNNSAIIVQGITQVRQPTCCRKSDFSKHQQTHTGEKPHECVECEKPSISKSDLMIQHKMPTEEKPYACNWCEKLFSYKSSLTIHQRIHTGEKPYGCNECGKTVRCKSFLTLHQRTHTGDKPYKCIECGKTFTVNQLLTLHHRTHSGEKPYQCSECGKTFSQKSYLTIHHRTHTWQKPYACDHCEKAFNHKSKLTVHQRTHTGEKPYECNECRKPFINKSNLRIHQRTHIRKNPMNAMNVGKRFTKSRSSLSIKGLTKAKNPTNATNVGKPFTICHSSLSIRELILGKKHMHVTNVEKRIATSH

SEQ ID NO: 869292 - protein, 262 aa, Homo sapiens
ASLWKGSLRLGTEAAARRTAGAMYLRRAVSKTLALPLRAPPNPAPLGKDASLRRMSSNRFPGSSGSNMIYYLVVGVTVSAGGYYAYKTVTSDQAKHTEHKTNLKEKTKAEIHPFQGEKENVAETEKASSEAPEELIVEAEVVDAEESPSATVVVIKEASACPGHVEAAPETTAVSAETGPEVTDAAARETTEVNPETTPEVTNAALDEAVTIDNDKDTTKNETSDEYAELEEENSPAESESSAGDDLQEEASVGSEAASAQG

SEQ ID NO: 869293 - protein, 333 aa, Homo sapiens
MKGKEEKEGGARLGAGGGSPEKSPSAQELKEQGNRLFVGRKYPEAAACYGRAIPERRSWDGPWVRVGTLSLRPHAAGPALVPMTRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 869294 - protein, 303 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 869295 - protein, 303 aa, Homo sapiens; identical to SEQ ID NO: 869294

SEQ ID NO: 869296 - protein, 231 aa, Homo sapiens
MQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 869297 - protein, 349 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHVRVPPTHMWVCVCARGVGASPPCVGSVPMEEGGGVSPPSTALNSSQDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 869298 - protein, 246 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHVRVPPTHMTSTWRTWTSFFLRWMRRGRSETSPTTCVARSALS

SEQ ID NO: 869299 - protein, 266 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKVSVCRLLPMAGRCSCSAPFQPLTVCPCATEARHPRLPVWQDQL

SEQ ID NO: 869300 - protein, 265 aa, Homo sapiens [sequence omitted]

SEQ ID NO: 869301 - protein, 279 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQVRPAAGGAGPVAWSWAP

SEQ ID NO: 869302 - protein, 266 aa, Homo sapiens; identical to SEQ ID NO: 869299

SEQ ID NO: 869303 - protein, 265 aa, Homo sapiens [sequence omitted]

SEQ ID NO: 869304 - protein, 201 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHRDVARDVARDVSGASSI

SEQ ID NO: 869305 - protein, 98 aa, Homo sapiens
GMCCGRSRGSLSTLEDAAPEDGGGVSPPSTALNSSQDKYMADMDELFSQVDEKRKVSVCRLLPMAGRCSCSAPFQPLTVCPCATEARHPRLPVWQDQL

SEQ ID NO: 869306 - protein, 303 aa, Homo sapiens; identical to SEQ ID NO: 869294

SEQ ID NO: 869307 - protein, 303 aa, Homo sapiens; identical to SEQ ID NO: 869294

SEQ ID NO: 869308 - protein, 483 aa, Homo sapiens
LGSNSDFLYNCLISLFWAVCCSSGSPSFCYLRQVKLVSHPSVVKARKAMLSGSAHSFGDNQLSRVPPTPAGNKSRTAAVSLRCPCNHGFDKVSVSWGINDSHIVLAGLKFPQGDINGDTTFTLSFHLSKTQAYLKEPFPISAASFSNFFNGSFVDATAFIDQMASSGGLARIYVSNDDNVDMSLFLSHFGFLGVVFTTPVFGGPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 869309 - protein, 284 aa, Homo sapiens
MKGKEEKEGGARLGAGGGSPEKSPSAQELKEQGNRLFVGRKYPEAAACYGRAIMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 869310 - protein, 303 aa, Homo sapiens; identical to SEQ ID NO: 869294

SEQ ID NO: 869311 - protein, 279 aa, Homo sapiens; identical to SEQ ID NO: 869301

SEQ ID NO: 869312 - protein, 265 aa, Homo sapiens [sequence omitted]

SEQ ID NO: 869313 - protein, 230 aa, Homo sapiens
MKGKEEKEGGARLGAGGGSPEKSPSAQELKEQGNRLFVGRKYPEAAACYGRAICQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQVRPAAGGAGPVAWSWAP

SEQ ID NO: 869314 - protein, 137 aa, Homo sapiens
MDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 869315 - protein, 137 aa, Homo sapiens; identical to SEQ ID NO: 869314

SEQ ID NO: 869316 - protein, 137 aa, Homo sapiens; identical to SEQ ID NO: 869314

SEQ ID NO: 869317 - protein, 137 aa, Homo sapiens; identical to SEQ ID NO: 869314

SEQ ID NO: 869318 - protein, 135 aa, Homo sapiens
MDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSCSGELEGLGSIVIAHIGHLENSSGNNCMTHLMPGNKI

SEQ ID NO: 869319 - protein, 112 aa, Homo sapiens
TRPNLRLGTRLGVAAWSCEWSVRCARACTMSVPAFIDISEEDQAAELRAYLKSKGAEISEENSEGGLHVDLAQIIEACDVCLKEDDKDVESVMNSVVSLLCDPGTRQARSFD

SEQ ID NO: 869320 - protein, 137 aa, Homo sapiens; identical to SEQ ID NO: 869314

SEQ ID NO: 869321 - protein, 137 aa, Homo sapiens; identical to SEQ ID NO: 869314

SEQ ID NO: 869322 - protein, 112 aa, Homo sapiens; identical to SEQ ID NO: 869319

SEQ ID NO: 869323 - protein, 108 aa, Homo sapiens
NLRLGTRLGAAWSCEWSVRCARACTMSVPAFIDISEEDQAAELRAYLKSKGAEISEENSEGGLHVDLAQIIEACDVCLKEDDKDVESVMNSVVSLLCDPGTRQARSFD

SEQ ID NO: 869324 - protein, 137 aa, Homo sapiens; identical to SEQ ID NO: 869314

SEQ ID NO: 869325 - protein, 191 aa, Homo sapiens
MVGIARKVTQRTNASQARVDAHRCIVRALKDPNAFLFDHLLTLKPVKFLEGELIHDSFNHFVSAKLASYVKFYQNNKDFIESPGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 869326 - protein, 137 aa, Homo sapiens; identical to SEQ ID NO: 869314

SEQ ID NO: 869327 - protein, 108 aa, Homo sapiens; identical to SEQ ID NO: 869323

SEQ ID NO: 869328 - protein, 108 aa, Homo sapiens; identical to SEQ ID NO: 869323

SEQ ID NO: 869329 - protein, 108 aa, Homo sapiens; identical to SEQ ID NO: 869323

SEQ ID NO: 869330 - protein, 60 aa, Homo sapiens
MRNDVCFRPSNAATFGVGGGESVVSISRVGKSNFVLKIKMPGRARWLTPLIPALWDAEAG

SEQ ID NO: 869331 - protein, 137 aa, Homo sapiens; identical to SEQ ID NO: 869314

SEQ ID NO: 869332 - protein, 137 aa, Homo sapiens; identical to SEQ ID NO: 869314

SEQ ID NO: 869333 - protein, 112 aa, Homo sapiens; identical to SEQ ID NO: 869319

SEQ ID NO: 869334 - protein, 112 aa, Homo sapiens; identical to SEQ ID NO: 869319

SEQ ID NO: 869335 - protein, 191 aa, Homo sapiens
MVGIARKVTQRTNASQARVDAHRCIVRALKDPNAFLFDHLLTLKPVKFLEGELIHDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 869336 - protein, 112 aa, Homo sapiens; identical to SEQ ID NO: 869319

SEQ ID NO: 869337 - protein, 191 aa, Homo sapiens; identical to SEQ ID NO: 869335

SEQ ID NO: 869338 - protein, 112 aa, Homo sapiens; identical to SEQ ID NO: 869319

SEQ ID NO: 869339 - protein, 191 aa, Homo sapiens
MVGIARKVTQRTNASQARVDAHRCIVRALKDPNAFLFDHLLTLKTSQVLEGELIHDLLTILGVLNGDPYVKFYQNNKDFIESPGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 869340 - protein, 137 aa, Homo sapiens; identical to SEQ ID NO: 869314

SEQ ID NO: 869341 - protein, 137 aa, Homo sapiens; identical to SEQ ID NO: 869314

SEQ ID NO: 869342 - protein, 85 aa, Homo sapiens
NLRLGTRLGAAWSCEWSVRCARACTMSVPAFIDISEEDQAAELRAYLKSKGAEISEENSEGGLHVDLAQIIEACDVCLKEDDKHQ

SEQ ID NO: 869343 - protein, 161 aa, Homo sapiens
MLLQSQTMGVSHSFTPKGITIPQREKPGHMYQNEDYLQNGLPTETTVLGFGITGSLSIISGKQSTKPFDLSSLTSNAVSSVTAGAGLFLLADSMVALRTASQHCGSEMDYLSSLPYSEYYYPIYEIKDCLLTSVSLTSSFSSTQSQDHIQQVKKSSSRSWI

SEQ ID NO: 869344 - protein, 240 aa, Homo sapiens
MLLQSQTMGVSHSFTPKGITIPQREKPGHMYQNEDYLQNGLPTETTVLGTVQILCCLLISSLGAILVFAPYPSHFNPAISTTLMSGYPFLGALCFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 869345 - protein, 102 aa, Homo sapiens
MVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 869346 - protein, 177 aa, Homo sapiens
MLLQSQTMGVSHSFTPKGITIPQREKPGHMYQNEDYLQNGLPTETTVLGFGITGSLSIISGSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 869347 - protein, 270 aa, Homo sapiens
FTSCVIINTALRKGQEVSEAGEQSTKIVLAGTASGRFQLSAPQSIISIMLLQSQTMGVSHSFTPKGITIPQREKPGHMYQNEDYLQNGLPTETTVLGTVQILCCLLISSLGAILVFAPYPSHFNPAISTTLMSGYPFLGALCFGITGSLSIISGSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 869348 - protein, 240 aa, Homo sapiens; identical to SEQ ID NO: 869344

SEQ ID NO: 869349 - protein, 102 aa, Homo sapiens
MLLQSQTMGVSHSFTPKGITIPQREKPGHMYQNEDYLQNGLPTETTVLGTVQILCCLLISSLGAILVFAPYPSHFNPAISTTLMSGYPFLGALCGEESMKTS

SEQ ID NO: 869350 - protein, 214 aa, Homo sapiens
MLLQSQTMGVSHSFTPKGITIPQREKPGHMYQNEDYLQNGLPTETTVLGTVQILCCLLISSLGAILVFAPYPSHFNPAISTTLMSGYPFLGALCFGITGSLSIISGKQSTKPFDLSSLTSNAVSSVTAGAGLFLLADSMVALRTASQHCGSEMDYLSSLPYSEYYYPIYEIKDCLLTSVSLTVSSFRLNILSCESSVSPLCILSAFLAVSGWSV

SEQ ID NO: 869351 - protein, 240 aa, Homo sapiens; identical to SEQ ID NO: 869344

SEQ ID NO: 869352 - protein, 240 aa, Homo sapiens; identical to SEQ ID NO: 869344

SEQ ID NO: 869353 - protein, 195 aa, Homo sapiens
MLLQSQTMGVSHSFTPKGITIPQREKPGHMYQNEDYLQNGLPTETTVLGFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 869354 - protein, 263 aa, Homo sapiens
MTQNCAKGRTEGGVSPRSSIISIMLLQSQTMGVSHSFTPKGITIPQREKPGHMYQNEDYLQNGLPTETTVLGTVQILCCLLISSLGAILVFAPYPSHFNPAISTTLMSGYPFLGALCFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 869355 - protein, 166 aa, Homo sapiens
MYQNEDYLQNGLPTETTVLGFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 869356 - protein, 121 aa, Homo sapiens
MTQNCAKGRTEGGVSPRSSIISIMLLQSQTMGVSHSFTPKGITIPQREKPGHMYQNEDYLQNGLPTETTVLGTVQILCCLLISSLGAILVFAPYPSHFNPAISTTLMSGYPFLGALCGRSQ

SEQ ID NO: 869357 - protein, 104 aa, Homo sapiens
MTFGEDCVLLKRQPGNWIIILSLILTTCVSWSVSSVPFLGLSLLTCQIRKLGKTILEVSLIEVIFLNVLHSPGVSLSLTESTLNKYCAIRLNLALEPHGPTLIL

SEQ ID NO: 869358 - protein, 125 aa, Homo sapiens
MEEDEFIGEKTFQRYCAEFIKHSQQIGDSWEWRPSKDCSDGYMCKIHFQIKNGSVMSHLGASTHGQTCLPMEVKSCSVTQAGVQLRDLSSLQPPPSGFKQFSCLSLPSNWDYRGSPLHLANFLYF

SEQ ID NO: 869359 - protein, 220 aa, Homo sapiens [sequence omitted]

SEQ ID NO: 869360 - protein, 184 aa, Homo sapiens
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSYQVPVLYFRASFLDGRPLTLKDIWEGVHECYKMRLLQGPWDTITQQEHPILGQPFFVLHPCKTNEFMTPVLKNSQKINK

SEQ ID NO: 869361 - protein, 184 aa, Homo sapiens; identical to SEQ ID NO: 869360

SEQ ID NO: 869362 - protein, 149 aa, Homo sapiens
MLVSYSLVMKVAVACEAGLMVLSFEAFELPLDDCEVIETAAASEVIKYGRPLTLKDIWEGVHECYKMRLLQGPWDTITQQEHPILGQPFFVLHPCKTNEFMTPVLKNSQKINKNVNYITSWLSIVGPVVGLNLPLSYAKATSQDERNVH

SEQ ID NO: 869363 - protein, 190 aa, Homo sapiens
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSYQVPVLYFRASFLDGRPLTLKDIWEGVHECYKMRLLQGPWDTITQQGQKRNIGYFDNLKADSRNITNSMTFATKSSNQNFIIFLE

SEQ ID NO: 869364 - protein, 150 aa, Homo sapiens
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSYQVPVLYFRASFLGKNMSEAKSKFITFTYKAKSIFGKLFSRGKKI

SEQ ID NO: 869365 - protein, 125 aa, Homo sapiens; identical to SEQ ID NO: 869358

SEQ ID NO: 869366 - protein, 220 aa, Homo sapiens [sequence omitted]

SEQ ID NO: 869367 - protein, 220 aa, Homo sapiens [sequence omitted]

SEQ ID NO: 869368 - protein, 107 aa, Homo sapiens
MSSHGDGRPLTLKDIWEGVHECYKMRLLQGPWDTITQQEHPILGQPFFVLHPCKTNEFMTPVLKNSQKINKNVNYITSWLSIVGPVVGLNLPLSYAKATSQDERNVH

SEQ ID NO: 869369 - protein, 206 aa, Homo sapiens
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSYQVPVLYFRASFLDGRPLTLKDIWEGVHECYKMRLLQGPWDTITQQEHPILGQPFFVLHPCKTNEFMTPVLKNSQKINKAKRETLATLTTLKRTPGISPTA

SEQ ID NO: 869370 - protein, 113 aa, Homo sapiens
VVYRHLAYADCSLAVVSYLQNSADADGRPLTLKDIWEGVHECYKMRLLQGPWDTITQQEHPILGQPFFVLHPCKTNEFMTPVLKNSQKINKAKRETLATLTTLKRTPGISPTA

SEQ ID NO: 869371 - protein, 227 aa, Homo sapiens
MADANKAEVPGATGGDSPHLQPAEPPGEPRREPHPAEAEKQQPQHSSSSNGVKMENDESAKEEKSDLKEKSTGSKKANRFHPYSKDKNSGTGEKKGPNRNRVFISNIPYDMKWQAIKDLMREKGVVEFKDEEFVKKALETMNKYDLSGRPLNIKEDPDGENARRALQRTGGSFPGGHVPDMGSGLMNLPPSILNNPNIPPEVISNLQAGRLGSTIFVANVSSSFSLK

SEQ ID NO: 869372 - protein, 576 aa, Homo sapiens
MADANKAEVPGATGGDSPHLQPAEPPGEPRREPHPAEAEKQQPQHSSSSNGVKMENDESAKEEKSDLKEKSTGSKKANRFHPYSKDKNSGTGEKKGPNRNRVFISNIPYDMKWQAIKDLMREKVGEVTYVELFKDAEGKSRGCGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKAGRYKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGRGDIGINRGFGDSFGRLGGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 869373 - protein, 397 aa, Homo sapiens
MADANKAEVPGATGGDSPHLQPAEPPGEPRREPHPAEAEKQQPQHSSSSNGVKMENDESAKEEKSDLKEKSTGSKKANRFHPYSKDKNSGTGEKKGPNRNRVFISNIPYDMKWQAIKDLMREKVGEVTYVELFKDAEGKSRGCGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKAGRYKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGMYKDLFFCMYPSPFLIN

SEQ ID NO: 869374 - protein, 302 aa, Homo sapiens
MGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGRGDIGINRGFGDSFGRLGGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 869375 - protein, 397 aa, Homo sapiens; identical to SEQ ID NO: 869373

SEQ ID NO: 869376 - protein, 600 aa, Homo sapiens
MADANKAEVPGATGGDSPHLQPAEPPGEPRREPHPAEAEKQQPQHSSSSNGVKMENDESAKEEKSDLKEKSTGSKKANRFHPYSKDKNSGTGEKKGPNRNRVFISNIPYDMKWQAIKDLMREKVGEVTYVELFKDAEGKSRGCGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKAGRYKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGRGDIGINRGFGDSFGRLGSAMIGGFAGRIGSSNMGPVGSGISGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 869377 - protein, 576 aa, Homo sapiens; identical to SEQ ID NO: 869372

SEQ ID NO: 869378 - protein, 556 aa, Homo sapiens
MADANKAEVPGATGGDSPHLQPAEPPGEPRREPHPAEAEKQQPQHSSSSNGVKMENDESAKEEKSDLKEKSTGSKKANRFHPYSKDKNSGTGEKKGPNRNRVFISNIPYDMKWQAIKDLMREKGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKAGRYKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGRGDIGINRGFGDSFGRLGGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 869379 - protein, 241 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELRWINPLSSSK

SEQ ID NO: 869380 - protein, 1451 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEDGEEDEVSAGEKEQDSDESYDDSD

SEQ ID NO: 869381 - protein, 1426 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKEDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEDGEEDEVSAGEKEQDSDESYDDSD

SEQ ID NO: 869382 - protein, 1551 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGEVLFTCWLGCTGEVTSILSVADTNFRIPFTSATAAQSHSFFPPNPSTPAPLAPKFLKGSLFVLLISPHDVVFEIGFALVVFPVALRIPELQHQILVFLRSDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEDGEEDEVSAGEKEQDSDESYDDSD

SEQ ID NO: 869383 - protein, 523 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKVSYWLLVL

SEQ ID NO: 869384 - protein, 112 aa, Homo sapiens
MLFISIQIHQDTRLTQHVPLLKKTLELLVCRVKAMLTLNNCREAFWLGNLKNRDLQGEEIKSQNSQESTADESEDDMSSQASKSKATEDGEEDEVSAGEKEQDSDESYDDSD

SEQ ID NO: 869385 - protein, 1471 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEVSLQNPPESGTDGCILLIVLSWWSRTLPTYVYCQMLLCPFPFPP

SEQ ID NO: 869386 - protein, 1451 aa, Homo sapiens; identical to SEQ ID NO: 869380

SEQ ID NO: 869387 - protein, 1451 aa, Homo sapiens; identical to SEQ ID NO: 869380

SEQ ID NO: 869388 - protein, 811 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFRESPQTMSLLLETLMWKL

SEQ ID NO: 869389 - protein, 232 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELR

SEQ ID NO: 869390 - protein, 187 aa, Homo sapiens
CSEIFASLRLPRIMAHSKQPSHFQSLMLLQWPLSYLAIFWILQPLFVYLLFTSLWPLPVLYFAWLFLDWKTPERGGRRSAWVRNWCVWTHIRDYFPITILKTKDLSPEHNYLMGVHPHGLLTFGAFCNFCTEATGFSKTFPGITPHLATLSWFFKIPFVREYLMAKGASDHTYWSFWSMFLLGNAPF

SEQ ID NO: 869391 - protein, 139 aa, Homo sapiens
MFFQGGSHPSLCLENKLEFSYRAHLVPTFTFGETEVYDQVLFHKDSRMYKFQSCFRRIFGFYCCVFYGQSFCQGSTGLLPYSRPIVTVVGEPLPLPQIEKPSQEMVDKYHALYMDALHKLFDQHKTHYGCSETQKLFFL

SEQ ID NO: 869392 - protein, 341 aa, Homo sapiens
CSEIFASLRLPRIMAHSKQPSHFQSLMLLQWPLSYLAIFWILQPLFVYLLFTSLWPLPVLYFAWLFLDWKTPERGGRRSAWVRNWCVWTHIRDYFPITILKTKDLSPEHNYLMGVHPHGLLTFGAFCNFCTEATGFSKTFPGITPHLATLSWFFKIPFVREYLMAKGVCSVSQPAINYLLSHGTGNLVGIVVGGVGEALQSVPNTTTLILQKRKGFVRTALQHGAHLVPTFTFGETEVYDQVLFHKDSRMYKFQSCFRRIFGFYCCVFYGQSFCQGSTGLLPYSRPIVTVVGEPLPLPQIEKPSQEMVDKYHALYMDALHKLFDQHKTHYGCSETQKLFFL

SEQ ID NO: 869393 - protein, 77 aa, Homo sapiens
MSPHPWERQAGDSAKDKGQVLNAGTRGASCEGRMVYGQPVRSDPASWEEELKLSPRRRRRSSPGSRLGRELQRLRQL

SEQ ID NO: 869394 - protein, 197 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQIPSPGHRHVCRSHRFQAWLLDWCPL

SEQ ID NO: 869395 - protein, 217 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQIPSPGHRHVCRTQFWFKIQLVWWVLYNMGNLEVLEPLPSSILAWN

SEQ ID NO: 869396 - protein, 239 aa, Homo sapiens
WGPGRGGAGPERTRECRDEGRVQRKIRRSRGRGQEARGWIAAPCVLTGGSFGGKGTWRWSLMQGAGPPWPPSSHPASSSQCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQIPSPGHRHVCRSHRFQAWLLDWCPL

SEQ ID NO: 869397 - protein, 146 aa, Homo sapiens
MELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQIPSPGHRHVCRSHRFQAWLLDWCPL

SEQ ID NO: 869398 - protein, 118 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQETRSALS

SEQ ID NO: 869399 - protein, 197 aa, Homo sapiens; identical to SEQ ID NO: 869394

SEQ ID NO: 869400 - protein, 197 aa, Homo sapiens; identical to SEQ ID NO: 869394

SEQ ID NO: 869401 - protein, 282 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQIPSPGHRHVCSLTPSPRLEAVVLSAHCILCLPGSSNSHASASRVAGIIGLTDFKPGYWIGVRYDEPLGKNDGSVNGKRYFECQAKYGAFVKPAVVTVGDFPEEDYGLDEI

SEQ ID NO: 869402 - protein, 226 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCLTDFKPGYWIGVRYDEPLGKNDGSVNGKRYFECQAKYGAFVKPAVVTVGDFPEEDYGLDEI

SEQ ID NO: 869403 - protein, 206 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQAPSPWAAAVRCGRRDKSPRRGTVMYVGLTDFKPGYWIGVRYDEPLGKNDGSVNGKRYFECQAKYGAFVKPAVVTVGDFPEEDYGLDEI

SEQ ID NO: 869404 - protein, 129 aa, Homo sapiens [sequence omitted]

SEQ ID NO: 869405 - protein, 285 aa, Homo sapiens
WGPGRGGAGPERTRECRDEGRVQRKIRRSRGRGQEARGWIAAPCVLTGGSFGGKGTWRWSLMQGAGPPWPPSSHPASSSQCKLELLVGSPASCMELELYGVDDKFYSKLDQEDALLGSYPVDDGCRIHKLAGRGGKMPVILATQEAEAGGSLEPRSWKLQGAEITPLHSSLDDRVIDHSGARLGEYEDVSRVEKYTISQEAYDQRQDTVRSFLKRSKLGRYNEEERAQQEAEAAQRLAEEKAQASSIPVGSRCEVRAAGQIPSPGHRHVCRSHRFQAWLLDWCPL

SEQ ID NO: 869406 - protein, 197 aa, Homo sapiens; identical to SEQ ID NO: 869394

SEQ ID NO: 869407 - protein, 239 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQIPSPGHRHVCSRCVARGPGPGLQGSKAGRKCWGHSGASETTLCLGARGWGGLETISVPGGDGTICRH

SEQ ID NO: 869408 - protein, 151 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQGEVRAAGQIPSPGHRHVCRSHRFQAWLLDWCPL

SEQ ID NO: 869409 - protein, 38 aa, Homo sapiens
MRGGGRAGIRMAGLRLSVPTWPSSRNPENKKTFPGPDP

SEQ ID NO: 869410 - protein, 127 aa, Homo sapiens
HASALLALGAPWRAGPCWRCGSSACSAVWWPPRADFDLAMPFLMEETVTQHHLMPPNQSQIQTPTDLVSLVTQHHLIPPNQSQIQIPTDLVSLIRASNPTGWSLCSVYLAVMSVSSEKRRFQGLTLT

SEQ ID NO: 869411 - protein, 127 aa, Homo sapiens; identical to SEQ ID NO: 869410

SEQ ID NO: 869412 - protein, 382 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQACLLHHGTPALTNPWLPHQQEGALPGGWSPQAHNSTVWKL

SEQ ID NO: 869413 - protein, 307 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGRRNQDKDA

SEQ ID NO: 869414 - protein, 350 aa, Homo sapiens
MALPPGPAALRHTLLLLPALLSSGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQACLLHHGTPALTNPWLPHQQEGALPGGWSPQAHNSTVWKL

SEQ ID NO: 869415 - protein, 351 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGRRNQDKDA

SEQ ID NO: 869416 - protein, 338 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQACLLHHGTPALTNPWLPHQQEGALPGGWSPQAHNSTVWKL

SEQ ID NO: 869417 - protein, 351 aa, Homo sapiens; identical to SEQ ID NO: 869415

SEQ ID NO: 869418 - protein, 119 aa, Homo sapiens
SCVAFFTLPGSLARHDVGYLAKAILCRPRGRCSLCIIHSPHDVLEVNLGCLSLARGIGISRAFPFAHLTFSYLVNCMHLPPAQDYKYELIMICMFSLWVQAFPYRRATVEVMGKYVLNW

SEQ ID NO: 869419 - protein, 129 aa, Homo sapiens
MQQGTVAFEDVAVNFSQEEWSLLSEVQRCLYHDVMLENWVLISSLGCWCGSEDEEAPSKKSISIQRVSQNVRLSAQAGVARSQLTAASTSRVQAILLPQPPGDLKGISLCPPHLFIFGKLYAFASSPRL

SEQ ID NO: 869420 - protein, 276 aa, Homo sapiens
MQQGTVAFEDVAVNFSQEEWSLLSEVQRCLYHDVMLENWVLISSLGCWCGSEDEEAPSKKSISIQRVSQVSTPGAGVSPKKAHSCEMCGAILGDILHLADHQGTHHKQKLHRCEAWGNKLYDSSNRPHQNQYLGEKPYRSSVEEALFVKRCKFHVSEESSIFIQSGKDFLPSSGLLLQEATHTGEKSNSKPECESPFQWGDTHYSCGECMKHSSTKHVFVQQQRLPSREECYCWECGKSFSKYDSVSNHQRVHTGKRPYECGECGKSFSHKGSLVQ

SEQ ID NO: 869421 - protein, 234 aa, Homo sapiens
MAEAEGESLESWLNKATNPSNRQEDWEYIIGFCDQINKELEGPQIAVRLLAHKIQSPQEWEALQALTYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKVGPPTAKAASRGCAALQE

SEQ ID NO: 869422 - protein, 723 aa, Homo sapiens
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 869423 - protein, 688 aa, Homo sapiens
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQALAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 869424 - protein, 756 aa, Homo sapiens
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGEVKERRSGISQAFGYVGGNCHNRSEKSLFPAPGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 869425 - protein, 328 aa, Homo sapiens
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNRALLLS

SEQ ID NO: 869426 - protein, 125 aa, Homo sapiens
LCWVSLVLLLPHSRHVLTGSALPVTAYDKNGFRILFHFAKECPPGRPDVLVVVVSMLNTAPLPVKSIVLQAAVPKVPVSPWGQNGLILTLLCRGLCSQQVAVCVCTAGSIWGHLPVLFKGVSLSL

SEQ ID NO: 869427 - protein, 79 aa, Homo sapiens
LGESPAALAGSLTCFPSFPPPRTSGLVKPTTSPLIPTTTPARPLLPFSTGPGSPLFQPLSFQSQGSPPKGPELSLASIH

SEQ ID NO: 869428 - protein, 690 aa, Homo sapiens
MAEAEGESLESWLNKATNPSNRQEDWEYIIGFCDQINKELEGPQIAVRLLAHKIQSPQEWEALQALTYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 869429 - protein, 723 aa, Homo sapiens; identical to SEQ ID NO: 869422

SEQ ID NO: 869430 - protein, 820 aa, Homo sapiens
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSRCWRIEVGGAVGPIATELEDMRQGWIQALFAGGPLKPGGLPACILSLKLLTERLSQIPLGSTGLIMTTESALFSSPPGLCWVSLVLLLPHSRHVLTGSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 869431 - protein, 93 aa, Homo sapiens
VKKCPGSFNADEDDRVDIWAPSRSRTSNSLPAPTPTTLPSPGSWGSLCQAWVCLAWDEAAHGVMSCVLVPGSGRLCPMDILAGHGIWPHDRPN

SEQ ID NO: 869432 - protein, 267 aa, Homo sapiens
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKVGPPTAKAASRGCAALQE

SEQ ID NO: 869433 - protein, 653 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQIIDILWSDPRGKNGCFPNTCRGGGCYFGPDVTSKILNKYQLKMLIRSHECKPEGYEICHDGKVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 869434 - protein, 653 aa, Homo sapiens; identical to SEQ ID NO: 869433

SEQ ID NO: 869435 - protein, 506 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQIIDILWSDPRGKNGCFPNTCRGGGCYFGPDVTSKILNKYQLKMLIRSHECKPEGYEICHDGKVVTIFSASNYYEEGSNRGAYIKLCSGTTPRFFQYQVTKATCFQPLRQRVDTMENSAIKILRERVISRKSDLTRAFQLQDHRKSGSFYSS

SEQ ID NO: 869436 - protein, 653 aa, Homo sapiens; identical to SEQ ID NO: 869433

SEQ ID NO: 869437 - protein, 142 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQQILMPLCLEY

SEQ ID NO: 869438 - protein, 196 aa, Homo sapiens
MPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMNLVLITPTEQREHDMIESHKVRVALMDWRIKMVLYEINELLGR

SEQ ID NO: 869439 - protein, 1022 aa, Homo sapiens
VAGAAIVLRSWALGEPPTSPGRAPTAGAWMRRRPEPGRTRGGRARETRRQPRHRSGRRMAEAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWCIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPNPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRTRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEHTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 869440 - protein, 151 aa, Homo sapiens
ALLIGMYCKTHNKGLEMHQLLAELSVIVYWTIPKLSGIKQPYIFFSHCCELTGISGQCLLGASSPVAAIWLKKWVLAKAWLGWGMHTMVPSLLCLVPLCPPGDSLSGRIAQTFYPLGSSFHGQGKKLAAFLKARPGLGTASLSLYSIHQST

SEQ ID NO: 869441 - protein, 136 aa, Homo sapiens
MYQNCPSPLAPPPCAKTSPGRTHTWAPVCTLSRGACACTPAYLQRLAFEPLDLRVGSSQCVCGYGHGPCPQSKQDSTSCATTAWPHFGAGAAQTTSLCGLCFLLPFLALLCSSPHPAGKRNPQLPPSPGARWEKWV

SEQ ID NO: 869442 - protein, 377 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869443 - protein, 173 aa, Homo sapiens
MSDSRGPGYLEEGKRCPVKEPVSPPASLLQQPELESDPERTLAMDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISQKASLCNI

SEQ ID NO: 869444 - protein, 107 aa, Homo sapiens
MSNLDSNRDNEVDFQEYCVFLSCIAMMCNEFFEGFPDKQPRKKENSSDVVGGSATGAAGSHFVGSAAHEVTEMFSYEESNPKDPAAVTESKEGTEASASKGLEKKEK

SEQ ID NO: 869445 - protein, 377 aa, Homo sapiens; identical to SEQ ID NO: 869442

SEQ ID NO: 869446 - protein, 426 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYESSAEILPHTPRLTHFPTVSGSPASLADSMQQKLAGPRRRRPQNPSAIYEESNPKDPAAVTESKEGTEASASKGLEKKEK

SEQ ID NO: 869447 - protein, 394 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYESSAEILPHTPRLTHFPTVSGSPASLADSMQQKLAGPRRRRPQNPSAM

SEQ ID NO: 869448 - protein, 317 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQL

SEQ ID NO: 869449 - protein, 377 aa, Homo sapiens; identical to SEQ ID NO: 869442

SEQ ID NO: 869450 - protein, 345 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFR

SEQ ID NO: 869451 - protein, 345 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFS

SEQ ID NO: 869452 - protein, 317 aa, Homo sapiens; identical to SEQ ID NO: 869448

SEQ ID NO: 869453 - protein, 331 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQGGQDGIRVSGMPHCK

SEQ ID NO: 869454 - protein, 344 aa, Homo sapiens
MDSALSDPHNGSAEAGGPTNSTTRPPSTPEGIALAYGSLLLMALLPIFFGALRSVRCARGKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869455 - protein, 253 aa, Homo sapiens [sequence omitted]

SEQ ID NO: 869456 - protein, 253 aa, Homo sapiens [sequence omitted]

SEQ ID NO: 869457 - protein, 253 aa, Homo sapiens [sequence omitted]

SEQ ID NO: 869458 - protein, 335 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869459 - protein, 192 aa, Homo sapiens
DYEGADGVRQVQDPSTKKYMDTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869460 - protein, 243 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKCK

SEQ ID NO: 869461 - protein, 112 aa, Homo sapiens
EPWVQAQPLTCYGPGPVTVLQSSPEGVWGAGHGPEAVPCPAWLHQPVSSHEPALLYLVPACIGFPVLVALAKGEVTEMFSYEESNPKDPAAVTESKEGTEASASKGLEKKEK

SEQ ID NO: 869462 - protein, 130 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISQKASLCNI

SEQ ID NO: 869463 - protein, 203 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKVYFPNKSYAGSVLKTWKTQKSKKGKTAVIQNPTTRDSHSFPSEIFSQEYINLLLSMYFFVLGILALSHTISALHLRCLLGIWHQCDGDSGQVLRGTNKIYRLSISNPKI

SEQ ID NO: 869464 - protein, 135 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPKRGAPFPKLANI

SEQ ID NO: 869465 - protein, 120 aa, Homo sapiens
GALRSVRCARGKVGSAGKPGTFHPHTEHGRHGPFLGGTDTSPRTLTLPSPDHHRSLCLGPTFRGWHFLPRDLGTDPRPGYDTFPNRNLLLLPTRTLTLPSLCIMPRLGTLSARPPLRLGH

SEQ ID NO: 869466 - protein, 92 aa, Homo sapiens
REPINPTCMVLQGSERGTESVRHASKEERKMLPGGQATVSACHGSTGSWRQAVVGGDWGRFHSGDQETAVFLVTHSTTADSLSPCVEESFMA

SEQ ID NO: 869467 - protein, 377 aa, Homo sapiens; identical to SEQ ID NO: 869442

SEQ ID NO: 869468 - protein, 377 aa, Homo sapiens; identical to SEQ ID NO: 869442

SEQ ID NO: 869469 - protein, 377 aa, Homo sapiens; identical to SEQ ID NO: 869442

SEQ ID NO: 869470 - protein, 420 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKVYFPNKSYAGSVLKTWKTQKSKKGKTAVIQNPTTRDSHSFPSEIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869471 - protein, 253 aa, Homo sapiens [sequence omitted]

SEQ ID NO: 869472 - protein, 280 aa, Homo sapiens
MVRACGEIGRGFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869473 - protein, 149 aa, Homo sapiens [sequence omitted]

SEQ ID NO: 869474 - protein, 149 aa, Homo sapiens [sequence omitted]

SEQ ID NO: 869475 - protein, 334 aa, Homo sapiens
SGRPRGARAGLPAGDSTGALPIPFVSLLSPASPWIMFKKFDEKESVSNCIQLKTSVIKGIKSQLVEQFPDKKTEAQRGHCLPQGHPATSNKACASNTKDHFPLTLCQAEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869476 - protein, 211 aa, Homo sapiens
MPSSVQGLTGGRGSPASGSGLTWPLCSEIINYEFDTKDLVCLGLSSIVGVWYLLRKVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869477 - protein, 285 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISALHLHVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869478 - protein, 144 aa, Homo sapiens
MIAPRWNTRLGTRTQSPVSSLPCCFPATLYPQLSPTGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 869479 - protein, 251 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVSQAGMPRMSGSGAISSHHPASLAQVAVI

SEQ ID NO: 869480 - protein, 107 aa, Homo sapiens; identical to SEQ ID NO: 869444

SEQ ID NO: 869481 - protein, 130 aa, Homo sapiens; identical to SEQ ID NO: 869462

SEQ ID NO: 869482 - protein, 84 aa, Homo sapiens
MVRACGEIGRGFFVLGILALSHTISPFMNKFFPASFPNRQYQLLFTQGSGENKEEIINYESHTISPFMNKFFPASFPNRAKCRN

SEQ ID NO: 869483 - protein, 124 aa, Homo sapiens
SVSHWSAGLGAAATPHPSARSRVRMPPLSDHCPNRLLVLGPRVADSLVLDQAQEGSALGQITRLSRVLVAGEAEGVSAGLSIPGTNRILSFFPEKCWSRLFRPTLPSKHIHPERNNRNQNSQGA

SEQ ID NO: 869484 - protein, 93 aa, Homo sapiens
AAARDLELPTRPADSLVLDQAQEGSALGQITRLSRVLVAGEAEGVSAGLSIPGTNRILSFFPEKCWSRLFRPTLPSKHIHPERNNRNQNSQGA

SEQ ID NO: 869485 - protein, 2100 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKAFRTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869486 - protein, 2128 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869487 - protein, 2106 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEMINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869488 - protein, 1347 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSTS

SEQ ID NO: 869489 - protein, 2128 aa, Homo sapiens; identical to SEQ ID NO: 869486

SEQ ID NO: 869490 - protein, 1910 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQLLNKAGHL

SEQ ID NO: 869491 - protein, 1599 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTTEV

SEQ ID NO: 869492 - protein, 930 aa, Homo sapiens
LLRPGYYGRMAPTVVLITATAYTLRKEGEQLEGLEDTSCDHSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869493 - protein, 872 aa, Homo sapiens
AAELPQADGVEVTATPSNCAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869494 - protein, 719 aa, Homo sapiens
YKMCILNTAVELSAFSIVLLRCKRLVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869495 - protein, 822 aa, Homo sapiens
SAAQHGATTCTARTTQPTHHQQRQVALDLGWQVALFQLERLVQQHRLLAAPAFRRITQAFARNAVETVAMRAGDYKRFGHGGLLGVANGFNLEPAMRFIKTRRKDETLIVPTLRVVMHPVVLLRCKRLVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869496 - protein, 1109 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSAGTSASKIFLEGSATAGIL

SEQ ID NO: 869497 - protein, 1007 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPGKENQ

SEQ ID NO: 869498 - protein, 170 aa, Homo sapiens
MAKRTRRGDNQDFSLKKMTHQHSVQPQPLQALWARREAKCSERALQLPAQEDSGLGAAATPHPSARSRVRMPPLSDHCPNRLLVLGPRVADSLVLDQAQEGSALGQITRLSRVLVAGEAEGVSAGLSIPGTNRILSFFPEKCWSRLFRPTLPSKHIHPERNNRNQNSQGA

SEQ ID NO: 869499 - protein, 478 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGMCLCLLYQ

SEQ ID NO: 869500 - protein, 138 aa, Homo sapiens
PFFLPISVCLPLFCSGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869501 - protein, 188 aa, Homo sapiens
SAAQHGATTCTARTTQPTHHQQRQVALDLGWQVALFQLERLVQQHRLLAAPAFRRITQAFARNAVETVAMRAGDYKRFGHGGLLGVANGFNLEPAMRFIKTRRKDETLIVPTLRVVMHPVVLLRCKRLVVPPAATSTSSTAVFGSLPVTSAGSSGVISFGGTSLSAGKTSFSFGSQQTNSTVPPSAPP

SEQ ID NO: 869502 - protein, 105 aa, Homo sapiens
VLAFELLTSSFPFFLPILIWFLIAQCLLFLSPPFFLPISVCLPLFCSGGFGAAPVFGSPPTFGGSPGFGGVPAFGSAPAFTSPLGSTGGKVFGEGTAAASAGGFG

SEQ ID NO: 869503 - protein, 2128 aa, Homo sapiens; identical to SEQ ID NO: 869486

SEQ ID NO: 869504 - protein, 2133 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSENSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGSLAMSLSPTLKGRLLLMRPKAGGGREQAAPGRKSNESRSLGHLCMERALTSPLKVWEQQQHHILRHARESECPHFRITVPTDFWFWDPE

SEQ ID NO: 869505 - protein, 196 aa, Homo sapiens
KSAMAASETQLLLAGVASSASTQSQSASLDGPDTQWLKEQGEEITKFQPQKDDPPAFGSAPAFTSPLGSTGGKVFGEGTAAASAGGFGFGSSSNTTSFGTLASQNAPTFGSLSQQTSGFGTQSSGFSGFGSGTGGLSRVLVAGEAEGVSAGLSIPGTNRILSFFPEKCWSRLFRPTLPSKHIHPERNNRNQNSQGA

SEQ ID NO: 869506 - protein, 1599 aa, Homo sapiens; identical to SEQ ID NO: 869491

SEQ ID NO: 869507 - protein, 2128 aa, Homo sapiens; identical to SEQ ID NO: 869486

SEQ ID NO: 869508 - protein, 2118 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNS

SEQ ID NO: 869509 - protein, 2135 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGSALGQITRLSAFGASIRPDPLDERS

SEQ ID NO: 869510 - protein, 1904 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQYL

SEQ ID NO: 869511 - protein, 1904 aa, Homo sapiens; identical to SEQ ID NO: 869510

SEQ ID NO: 869512 - protein, 1894 aa, Homo sapiens
WTLEKPQLLQLVLQQRLLLRGKYLSTLEDGQAIPGPPFYNVDTGVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869513 - protein, 1603 aa, Homo sapiens
KTSYDTMSYRISSSGTPSEQCWEPAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869514 - protein, 1905 aa, Homo sapiens
QLRAAGAEGRKFAVERPGFRGQGRGRQRWLLRHTEGGAMGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKSSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASDTLRMETVFEEMDEESTGGRFIFESKK

SEQ ID NO: 869515 - protein, 916 aa, Homo sapiens
MKSSLLLRGVHFCFHLPGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVVPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 869516 - protein, 246 aa, Homo sapiens [sequence omitted]

SEQ ID NO: 869517 - protein, 736 aa, Homo sapiens
CVWNKNHCESWESGNTNNILRAKCPPKTAASDDRCYRYADCASCTANTNGCQWCDDKKCISANSNCSMSVKNYTKCHVRNEQICNKLTSCKSCSLNLNCQWDQRQQECQALPAHLCGEGWSHIGDACLRVNSSRENYDNAKLYCYNLSGNLASLTTSKEVEFVLDEIQKYTQQKVSPWVGLRKINISYWGWEDMSPFTNTTLQWLPGEPNDSGFCAYLERAAVAGLKANPCTSMANGLVCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACQCNGHSTCINNNVCEQCKNLTTGKQCQDCMPGYYGDPTNGGQCTACTCSGHANICHLHTGKCFCTTKGIKGDQCQLCDSENRYVGNPLRGTCYSYYRKMIATITAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDLVQFFVTFFSCFLSLLLVAAVVWKIKQTCWASRRREQLLRERQQMASRPFASVDVALEVGAEQTEFLRGPLEGAPKPIAIEPCAGNRAAVLTVFLCLPRGSSGAPPPGQSGLAIASALIDISQQKASDSKDKTSGVRNRKHLSTRQGTCV

SEQ ID NO: 869518 - protein, 747 aa, Homo sapiens
CVWNKNHCESWESGNTNNILRAKCPPKTAASDDRCYRYADCASCTANTNGCQWCDDKKCISANSNCSMSVKNYTKCHVRNEQICNKLTSCKSCSLNLNCQWDQRQQECQALPAHLCGEGWSHIGDACLRVNSSRENYDNAKLYCYNLSGNLASLTTSKEVEFVLDEIQKYTQQKVSPWVGLRKINISYWGWEDMSPFTNTTLQWLPGEPNDSGFCAYLERAAVAGLKANPCTSMANGLVCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACQCNGHSTCINNNVCEQCKNLTTGKQCQDCMPGYYGDPTNGGQCTACTCSGHANICHLHTGKCFCTTKGIKGDQCQLCDSENRYVGNPLRGTCYYSLLIDYQFTFSLLQEDDRHHTAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDLVQFFVTFFSCFLSLLLVAAVVWKIKQTCWASRRREQLLRERQQMASRPFASVDVALEVGAEQTEFLRGPLEGAPKPIAIEPCAGNRAAVLTVFLCLPRGSSGAPPPGQSGLAIASALIDISQQKASDSKDKTSGVRNRKHLSTRQGTCV

SEQ ID NO: 869519 - protein, 689 aa, Homo sapiens
CVWNKNHCESWESGNTNNILRAKCPPKTAASDDRCYRYADCASCTANTNGCQWCDDKKCISANSNCSMSVKNYTKCHVRNEQICNKLTSCKSCSLNLNCQWDQRQQECQALPAHLCGEGWSHIGDACLRVNSSRENYDNAKLYCYNLSGNLASLTTSKEVEFVLDEIQKYTQQKVSPWVGLRKINISYWGWEDMSPFTNTTLQWLPGEPNDSGFCAYLERAAVAGLKANPCTSMANGLVCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACQCNGHSTCINNNVCEQCKNLTTGKQCQDCMPGYYGDPTNGGQCTACTCSGHANICHLHTGKCFCTTKGIKGDQCQLCDSENRYVGNPLRGTCYSYYRKMIATITAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDLVQFFVTFFSCFLSLLLVAAVVWKIKQTCWASRRRETESHSCHPGWRAVWGSQLTATSASWVKQFSITGAHYHAQLIFVFFSRDGVSPCWPDWTSGDLPTSAS

SEQ ID NO: 869520 - protein, 148 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWEDGCGRCHVLQSVSPRSLSCGRSTMCTAPSRKALTKSGWPSRPRGCWT

SEQ ID NO: 869521 - protein, 148 aa, Homo sapiens; identical to SEQ ID NO: 869520

SEQ ID NO: 869522 - protein, 148 aa, Homo sapiens; identical to SEQ ID NO: 869520

SEQ ID NO: 869523 - protein, 148 aa, Homo sapiens; identical to SEQ ID NO: 869520

SEQ ID NO: 869524 - protein, 157 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWEDGCGRCHVLQSVSPRSLSCGRSTMHVTNLRKMGAPESGLAEYLCDKHLAEAEAVRA

SEQ ID NO: 869525 - protein, 155 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWEDGFWAVPCFFQSVFNRASLIHCWARKHYCVNGPLPRKSFCKVGLPKQDQGGFDN

SEQ ID NO: 869526 - protein, 148 aa, Homo sapiens; identical to SEQ ID NO: 869520

SEQ ID NO: 869527 - protein, 148 aa, Homo sapiens; identical to SEQ ID NO: 869520

SEQ ID NO: 869528 - protein, 148 aa, Homo sapiens; identical to SEQ ID NO: 869520

SEQ ID NO: 869529 - protein, 148 aa, Homo sapiens; identical to SEQ ID NO: 869520

SEQ ID NO: 869530 - protein, 148 aa, Homo sapiens; identical to SEQ ID NO: 869520

SEQ ID NO: 869531 - protein, 159 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWEDGCGRCHVLQSVSPRSLSCGRSTMVSREGGRHGRLDWGSSLQCPLVGCGGPPYLEAMR

SEQ ID NO: 869532 - protein, 152 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWEDGCGRCHVLQSVSPRSLSCGRSTMCTAPSRKALTKSGWPSRPRSADSWYRA

SEQ ID NO: 869533 - protein, 119 aa, Homo sapiens
MCVNMMWPGLVYPSALCFLLHKCGFGEKWLNVAEEGAADLCACKWLSSLPPVYRIKFKESFAEMNRGSNEWEDGCGRCHVLQSVSPRSLSCGRSTMCTAPSRKALTKSGWPSRPRGCWT

SEQ ID NO: 869534 - protein, 159 aa, Homo sapiens; identical to SEQ ID NO: 869531

SEQ ID NO: 869535 - protein, 159 aa, Homo sapiens; identical to SEQ ID NO: 869531

SEQ ID NO: 869536 - protein, 155 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWEDGCGRCHVLQSVSPRSLSCGRSTIDMNHVGAFMPPSCCLYQPTPFLGMKGLDIE

SEQ ID NO: 869537 - protein, 133 aa, Homo sapiens
MCVNMMWPGLVYPSALCFLLHKCGFGEKWLNVAEEGAADLCACKWLSSLPPVYRIKFKESFAEMNRGSNEWEDGCGRCHVLQSVSPRSLSCGRSTMVSIEGRTLGPLDMAFILDLPICGPLRNLRPLGGLSVV

SEQ ID NO: 869538 - protein, 148 aa, Homo sapiens; identical to SEQ ID NO: 869520

SEQ ID NO: 869539 - protein, 148 aa, Homo sapiens; identical to SEQ ID NO: 869520

SEQ ID NO: 869540 - protein, 38 aa, Homo sapiens
MLDMKVNPIQGLASKWDYEKNEWKKGEKLCGREAVRPV

SEQ ID NO: 869541 - protein, 148 aa, Homo sapiens; identical to SEQ ID NO: 869520

SEQ ID NO: 869542 - protein, 110 aa, Homo sapiens
MDRRDHPLPEVAHVKHLSASQKALKEKEKASWSSLSMDEKVELYRIKFKESFAEMNRGSNEWEDGCGRCHVLQSVSPRSLSCGRSTMCTAPSRKALTKSGWPSRPRGCWT

SEQ ID NO: 869543 - protein, 179 aa, Homo sapiens
GRTYERTFHGRVIRTGDAAAGGGRNCAELREEGLQVGGAEAGAGGGADSEELLREHYSELRVRARGRTRMDRRDHPLPEVAHVKHLSASQKALKEKEKASWSSLSMDEKVELYRIKFKESFAEMNRGSNEWEDGCGRCHVLQSVSPRSLSCGRSTMCTAPSRKALTKSGWPSRPRGCWT

SEQ ID NO: 869544 - protein, 159 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWEDGCGRCHVLQSVSPRSLSCGRSTMVTLGSVCQILLSIAFREDLLLLAYFVANFLQTKG

SEQ ID NO: 869545 - protein, 130 aa, Homo sapiens
MCVNMMWPGLVYPSALCFLLHKCGFGEKWLNVAEEGAADLCACKWLSSLPPVYRIKFKESFAEMNRGSNEWEDGCGRCHVLQSVSPRSLSCGRSTMVSREGGRHGRLDWGSSLQCPLVGCGGPPYLEAMR

SEQ ID NO: 869546 - protein, 162 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWEDGCGRCHVLQSVSPRSLSCGRSTIFDKEWVAKQTKRMLDMKVNPIQGLASKWDYEKNEWKK

SEQ ID NO: 869547 - protein, 140 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWEDGCGRCHVLQSVSPRSLSCGRSTMGLASKWDYEKNEWKK

SEQ ID NO: 869548 - protein, 141 aa, Homo sapiens
MCVNMMWPGLVYPSALCFLLHKCGFGEKWLNVAEEGAADLCACKWLSSLPPVYRIKFKESFAEMNRGSNEWEDGCGRCHVLQSVSPRSLSCGRSTMCYRPPSRNFDKEWVAKQTKRMLDMKVNPIQGLASKWDYEKNEWKK

SEQ ID NO: 869549 - protein, 50 aa, Homo sapiens
MDRRDHPLPEVAHVKHLSASQKALKEKEKASWSSLSMETCQFMSRLYLQR

SEQ ID NO: 869550 - protein, 113 aa, Homo sapiens
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKL

SEQ ID NO: 869551 - protein, 99 aa, Homo sapiens
MAEGSRIPQARALLQQCLHARLQIRPADGDVAAQWVEVQRGLVIYVCFFKGADKELLPKMAEAGLYCCHLWLTATSLPDSPASACRVPAIAGGATTPDW

SEQ ID NO: 869552 - protein, 109 aa, Homo sapiens [sequence omitted]

SEQ ID NO: 869553 - protein, 168 aa, Homo sapiens
MAEGSRIPQARALLQQCLHARLQIRPADGDVAAQWVEVQRGLVIYVCFFKGADKELLPKMVNTLLNVKLSETENGKHVSILDLPGNILIIPQATLGGRLKGRNMQYHSNSGKEEGFELYSQFVTLCEKEVAANSKCAEARVVVEHGTYGNRQVLKLDTNGPFTHLIEF

SEQ ID NO: 869554 - protein, 113 aa, Homo sapiens; identical to SEQ ID NO: 869550

SEQ ID NO: 869555 - protein, 168 aa, Homo sapiens; identical to SEQ ID NO: 869553

SEQ ID NO: 869556 - protein, 168 aa, Homo sapiens; identical to SEQ ID NO: 869553

SEQ ID NO: 869557 - protein, 168 aa, Homo sapiens; identical to SEQ ID NO: 869553

SEQ ID NO: 869558 - protein, 168 aa, Homo sapiens; identical to SEQ ID NO: 869553

SEQ ID NO: 869559 - protein, 685 aa, Homo sapiens
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVENWDNKSYMTDIGIYNMPSYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLKLLRYSNTTTLASWVRADWMFYSSHPALFLSTYLGHGLLIDYFEKKRRRNNNNDEVNANNLEWLSSLWDWYTSYLFHPIASFQNFPVESDWDEDPDLFLERLAFPDLWLHPLIPTDYIKNLPMWRFKCLGVQSEEEMSEGSQDTENDSESENTDTLSSEKEVFEDKQSVLHNSPGTASHCDAEACSCANKYCQTSPCERKGRSYGSYNTNEDMEPDWLTWPADMLHCTECVVCLENFENGCLLMGLPCGHVFHQNCIVMWLAGGRHCCPVCRWPSYKKKQPYAQHQPLSNDVPS

SEQ ID NO: 869560 - protein, 412 aa, Homo sapiens
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVENWDNKSYMTDIGIYNMPSYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLTGCFTLHTQPCFSVHTLVMVY

SEQ ID NO: 869561 - protein, 685 aa, Homo sapiens; identical to SEQ ID NO: 869559

SEQ ID NO: 869562 - protein, 122 aa, Homo sapiens
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQ

SEQ ID NO: 869563 - protein, 681 aa, Homo sapiens
MSRLRPRPPLIHGCGGFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVENWDNKSYMTDIGIYNMPSYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLKLLRYSNTTTLASWVRADWMFYSSHPALFLSTYLGHGLLIDYFEKKRRRNNNNDEVNANNLEWLSSLWDWYTSYLFHPIASFQNFPVESDWDEDPDLFLERLAFPDLWLHPLIPTDYIKNLPMWRFKCLGVQSEEEMSEGSQDTENDSESENTDTLSSEKEVFEDKQSVLHNSPGTASHCDAEACSCANKYCQTSPCERKGRSYGSYNTNEDMEPDWLTWPADMLHCTECVVCLENFENGCLLMGLPCGHVFHQNCIVMWLAGGRHCCPVCRWPSYKKKQPYAQHQPLSNDVPS

SEQ ID NO: 869564 - protein, 667 aa, Homo sapiens
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVAYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLKLLRYSNTTTLASWVRADWMFYSSHPALFLSTYLGHGLLIDYFEKKRRRNNNNDEVNANNLEWLSSLWDWYTSYLFHPIASFQNFPVESDWDEDPDLFLERLAFPDLWLHPLIPTDYIKNLPMWRFKCLGVQSEEEMSEGSQDTENDSESENTDTLSSEKEVFEDKQSVLHNSPGTASHCDAEACSCANKYCQTSPCERKGRSYGSYNTNEDMEPDWLTWPADMLHCTECVVCLENFENGCLLMGLPCGHVFHQNCIVMWLAGGRHCCPVCRWPSYKKKQPYAQHQPLSNDVPS

SEQ ID NO: 869565 - protein, 132 aa, Homo sapiens
MSRLRPRPPLIHGCGGFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQLCQSGILKLFKTKC

SEQ ID NO: 869566 - protein, 221 aa, Homo sapiens
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAM

SEQ ID NO: 869567 - protein, 597 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 869568 - protein, 628 aa, Homo sapiens
ESVAAQAQAQRAEAVVVAAAGQCWLQQTSFKMSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 869569 - protein, 597 aa, Homo sapiens; identical to SEQ ID NO: 869567

SEQ ID NO: 869570 - protein, 597 aa, Homo sapiens; identical to SEQ ID NO: 869567

SEQ ID NO: 869571 - protein, 597 aa, Homo sapiens; identical to SEQ ID NO: 869567

SEQ ID NO: 869572 - protein, 326 aa, Homo sapiens
HRARPWLAEASTRERPQLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 869573 - protein, 544 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDDITSSVIFLRNIVWWQQSPCPYHC

SEQ ID NO: 869574 - protein, 597 aa, Homo sapiens; identical to SEQ ID NO: 869567

SEQ ID NO: 869575 - protein, 561 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRVS

SEQ ID NO: 869576 - protein, 401 aa, Homo sapiens [sequence omitted]

SEQ ID NO: 869577 - protein, 320 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPAS

SEQ ID NO: 869578 - protein, 284 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQATFFLTAGESTLGLVLPVRAGPPFERLAHVVRDFKLAARGVPI

SEQ ID NO: 869579 - protein, 203 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTAVLTP

SEQ ID NO: 869580 - protein, 134 aa, Homo sapiens
EGDKARSRLVAGGTGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 869581 - protein, 597 aa, Homo sapiens; identical to SEQ ID NO: 869567

SEQ ID NO: 869582 - protein, 597 aa, Homo sapiens; identical to SEQ ID NO: 869567

SEQ ID NO: 869583 - protein, 572 aa, Homo sapiens
MSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 869584 - protein, 597 aa, Homo sapiens; identical to SEQ ID NO: 869567

SEQ ID NO: 869585 - protein, 224 aa, Homo sapiens
VSICSLLQVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 869586 - protein, 597 aa, Homo sapiens; identical to SEQ ID NO: 869567

SEQ ID NO: 869587 - protein, 497 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLRCTYSLR

SEQ ID NO: 869588 - protein, 273 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQVRQGSIIATERIRHELEKSELQHGLGADSELL

SEQ ID NO: 869589 - protein, 253 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFERATSGKASPRKYNWSSVLMFK

SEQ ID NO: 869590 - protein, 122 aa, Homo sapiens [sequence omitted]

SEQ ID NO: 869591 - protein, 567 aa, Homo sapiens
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869592 - protein, 567 aa, Homo sapiens; identical to SEQ ID NO: 869591

SEQ ID NO: 869593 - protein, 597 aa, Homo sapiens
MWHRKQQTQGEGSIRHCREQWPHFLAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869594 - protein, 597 aa, Homo sapiens; identical to SEQ ID NO: 869593

SEQ ID NO: 869595 - protein, 567 aa, Homo sapiens; identical to SEQ ID NO: 869591

SEQ ID NO: 869596 - protein, 567 aa, Homo sapiens; identical to SEQ ID NO: 869591

SEQ ID NO: 869597 - protein, 567 aa, Homo sapiens; identical to SEQ ID NO: 869591

SEQ ID NO: 869598 - protein, 584 aa, Homo sapiens
MARYEAGFNRPRAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869599 - protein, 567 aa, Homo sapiens; identical to SEQ ID NO: 869591

SEQ ID NO: 869600 - protein, 567 aa, Homo sapiens; identical to SEQ ID NO: 869591

SEQ ID NO: 869601 - protein, 105 aa, Homo sapiens
MLERRCRGPLAMGLAQPRLLSGPSQESPQTLGKESRGLRQQGTSVAQSGAQAPGRAHRCAHCRRHFPGWVALWLHTRRCQARLPLPRPGPSYAATVAGALPSGTS

SEQ ID NO: 869602 - protein, 388 aa, Homo sapiens
MLCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869603 - protein, 410 aa, Homo sapiens
MARYEAGFNLAEARVGRGGRPSGSMDGRRVPAQPAAEAEEEPMLERRCRGPLAMGLAQPRLLSGPSQESPQTLGKESRGLRQQGGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869604 - protein, 176 aa, Homo sapiens
MWVFLGFRESIPSCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869605 - protein, 253 aa, Homo sapiens
TRRGEVGDGPGSCELEPAAVAAAGRGARVGRGGRPSGSMDGRRVPAQPAAEAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPDCDRSFSQKSNLITHRKSHIRDGAFCCAICGQTFDDEERLLAHQKKHDV

SEQ ID NO: 869606 - protein, 203 aa, Homo sapiens
MTELASSGGGSPAGDGEEGLGDERGLVIHHPAEEQPYRCPLCGQTFSQQPSLVRHQKAHAGAGRAAAFVCPECGKAFSVKHNLEVHQRTHTGERPFPCPECGRCFSLKQNLLTHQRIHSGEKPHQCAQCGRCFREPRFLLNHQRTHARMPAPHPRRPGVFGERRPYFCPRCGKSFAREGSLKTHQRSHGHGPEGQAAHLGRVL

SEQ ID NO: 869607 - protein, 203 aa, Homo sapiens; identical to SEQ ID NO: 869606

SEQ ID NO: 869608 - protein, 203 aa, Homo sapiens; identical to SEQ ID NO: 869606

SEQ ID NO: 869609 - protein, 537 aa, Homo sapiens
MESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSFSQKPNLARHQRHHTGERPFCCPECARRFSQKQHLLKHQKTHSRPATHSCPECERCFRHQVGLRIHQRAHARDRQGSRAGLHELIQDAAARRACRLQPGPPRGRPEWAWLGLCQGWWGQPGARAAVSGPEGPGEPRQFICNECGKSFTWWSSLNIHQRIHTGERPYACPECGRRFSQKPNLTRHLRNHTGERPHPCPHCGRGFRQKQHLLKHLRTHLPGAQAAPCPSCGKSCRSRAALRAHQRAHAVAEPAVPAGEPGDQPQAEAIPGLAARPRSSQRSPGARDTLWGRGQAGLAGPGEPRQFICNECGKSFSWWSALTIHQRIHTGERPYPCPECGRRFSQKPNLTRHRRNHTGERPYLCPACGRGFSQKQHLLKHQRVHRAAPACSPKEEAR

SEQ ID NO: 869610 - protein, 245 aa, Homo sapiens
MTELASSGGGSPAGDGEEGLGDERGLVIHHPAEEQPYRCPLCGQTFSQQPSLVRHQKAHAGAGRAAAFVCPECGKAFSVKHNLEVHQRTHTGERPFPCPECGRCFSLKQNLLTHQRIHSGEKPHQCAQCGRCFREPRFLLNHQRTHARMPAPHPRRPGVFGERRPYFCPRCGKSFAREGSLKTHQPLAWALEGVGRRQAPAARSRSSLGTLWLAAHSCFRLLPWFSFSGPSGLEQLQSGQDLKTR

SEQ ID NO: 869611 - protein, 232 aa, Homo sapiens
MESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSFSQKPNLARHQRHHTGERPLPVSRLRPRLQPEAAPAQAPARAPRGPCVQPQGGGALVDWTSADPWWCGGCLRGVCGEWGWPGLLALRTP

SEQ ID NO: 869612 - protein, 198 aa, Homo sapiens [sequence omitted]

SEQ ID NO: 869613 - protein, 121 aa, Homo sapiens
MARYEAGFNRPRREWAAEAGLRAPWTGAASLHSPPQRWQERDTAGADAGRPPGMESGLAGNGTGAGLVMKVKQEKPERLLQTLAPQAMLVEKDKENVLWTTLVFFFACGSFKLLVFKISTF

SEQ ID NO: 869614 - protein, 537 aa, Homo sapiens; identical to SEQ ID NO: 869609

SEQ ID NO: 869615 - protein, 131 aa, Homo sapiens
KVGLNNPAPPLSQGCCEDNGKQFKRNTVSWEEDPLEKQHEGSWVWGCWLGTEGAAQPWARLCCELTQGCLFLGCGLAPLGQKWMSEASGSYLLGAVGASGTPTPTPALQECTEVVVQPGYFYRLLTPAGAD

SEQ ID NO: 869616 - protein, 567 aa, Homo sapiens; identical to SEQ ID NO: 869591

SEQ ID NO: 869617 - protein, 567 aa, Homo sapiens; identical to SEQ ID NO: 869591

SEQ ID NO: 869618 - protein, 597 aa, Homo sapiens; identical to SEQ ID NO: 869593

SEQ ID NO: 869619 - protein, 623 aa, Homo sapiens
TRRGEVGDGPGSCELEPAAVAAAGRGARVGRGGRPSGSMDGRRVPAQPAAEAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869620 - protein, 610 aa, Homo sapiens
MAGACGFVGGGVVAGEDTKLTALEELRASLLFSLPSPQAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869621 - protein, 527 aa, Homo sapiens
MCRLTSALHSECYVDLWILNHTVSRPFVTLNAWLCRMIAPGQSSSDDASHFLRIVSTQSQAPSDYVVCNPPENLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869622 - protein, 567 aa, Homo sapiens; identical to SEQ ID NO: 869591

SEQ ID NO: 869623 - protein, 567 aa, Homo sapiens; identical to SEQ ID NO: 869591

SEQ ID NO: 869624 - protein, 406 aa, Homo sapiens
MSGALGVHRWQEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869625 - protein, 217 aa, Homo sapiens
MHPGLCSCSPRRAVLTCPPASYGDYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869626 - protein, 128 aa, Homo sapiens
FFIVFIWLCICSTTLFYRSFLCSDCCKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 869627 - protein, 203 aa, Homo sapiens; identical to SEQ ID NO: 869606

SEQ ID NO: 869628 - protein, 203 aa, Homo sapiens; identical to SEQ ID NO: 869606

SEQ ID NO: 869629 - protein, 203 aa, Homo sapiens; identical to SEQ ID NO: 869606

SEQ ID NO: 869630 - protein, 605 aa, Homo sapiens
EPGGGRLGTGLAVVNSNLPLSPRRGGEREWAAEAGLRAPWTGAASLHSPPQRWQERDTAGADAGRPPGMESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSFSQKPNLARHQRHHTGERPFCCPECARRFSQKQHLLKHQKTHSRPATHSCPECERCFRHQVGLRIHQRAHARDRQGSRAGLHELIQDAAARRACRLQPGPPRGRPEWAWLGLCQGWWGQPGARAAVSGPEGPGEPRQFICNECGKSFTWWSSLNIHQRIHTGERPYACPECGRRFSQKPNLTRHLRNHTGERPHPCPHCGRGFRQKQHLLKHLRTHLPGAQAAPCPSCGKSCRSRAALRAHQRAHAVAEPAVPAGEPGDQPQAEAIPGLAARPRSSQRSPGARDTLWGRGQAGLAGPGEPRQFICNECGKSFSWWSALTIHQRIHTGERPYPCPECGRRFSQKPNLTRHRRNHTGERPYLCPACGRGFSQKQHLLKHQRVHRAAPACSPKEEAR

SEQ ID NO: 869631 - protein, 203 aa, Homo sapiens; identical to SEQ ID NO: 869606

SEQ ID NO: 869632 - protein, 103 aa, Homo sapiens [sequence omitted]

SEQ ID NO: 869633 - protein, 103 aa, Homo sapiens
GGLSPGERGEGSARDRVMQVQTGRSLPALQPPAAPRQAKGGRAGVGREREAARLERAVRPTPAASRAPALTLRGPAHCEPGRAPRWQRLRAVLGRRWREPCAA

SEQ ID NO: 869634 - protein, 103 aa, Homo sapiens; identical to SEQ ID NO: 869633

SEQ ID NO: 869635 - protein, 103 aa, Homo sapiens; identical to SEQ ID NO: 869633

SEQ ID NO: 869636 - protein, 103 aa, Homo sapiens; identical to SEQ ID NO: 869633

SEQ ID NO: 869637 - protein, 103 aa, Homo sapiens
MFLSATLHPSISHPNLQKVTTGWARWLTPVIPASWEAKVQPWQKMAGHKGPAARCSWSQLSRTGLNLGPLQKHCSYFLPADLSPSHPSLHPPEYSGDITLTLK

SEQ ID NO: 869638 - protein, 103 aa, Homo sapiens; identical to SEQ ID NO: 869633

SEQ ID NO: 869639 - protein, 103 aa, Homo sapiens; identical to SEQ ID NO: 869633

SEQ ID NO: 869640 - protein, 103 aa, Homo sapiens; identical to SEQ ID NO: 869633

SEQ ID NO: 869641 - protein, 103 aa, Homo sapiens; identical to SEQ ID NO: 869633

SEQ ID NO: 869642 - protein, 103 aa, Homo sapiens; identical to SEQ ID NO: 869633

SEQ ID NO: 869643 - protein, 103 aa, Homo sapiens; identical to SEQ ID NO: 869633

SEQ ID NO: 869644 - protein, 380 aa, Homo sapiens
MTEEVIVIAKWDYTAQQDQELDIKKNERLWLLDDSKTWWRVRNAANRTGYVPSNYVERKNSLKKGSLVKNLKDTLGLGKTRRKTSARDASPTPSTDAEYPANGSGADRIYDLNIPAFVKFAYVAEREDELSLVKGSRVTVMEKCSDGWWRGSYNGQIGWFPSNYVLEEVDEAAAESPSFLSLRKGASLSNGQGSRVLHVVQTLYPFSSVTEEELNFEKGETMEVIEKPENDPEWWKCKNARGQVGLVPKNYVVVLSDGPALHPAHAPQISYTGPSSSGRFAGREWYYGNVTRHQAECALNERGVEGDFLIRDSESSPSDFSVSLKASGKNKHFKVQLVDNVYCIGQRRFHTMDELVEHYKKAPIFTSEHGEKLYLVRALQ

SEQ ID NO: 869645 - protein, 380 aa, Homo sapiens; identical to SEQ ID NO: 869644

SEQ ID NO: 869646 - protein, 380 aa, Homo sapiens; identical to SEQ ID NO: 869644

SEQ ID NO: 869647 - protein, 210 aa, Homo sapiens
MKDDRRSYCDSQVGLHRPAGPGAGHQEERAAVVAGRLQDVVAGEERGQQDGLCTVQLRGAEEQPEEGLPREEPEGHTSPATSPCPLKRQGRTNTSRCSSWTMSTALGSGASTPWTSWWNTTKRRPSSPASTGRSSTSSGPCSDGAPAPHSPPGPHGGAARPALWQRLLPRGRPRRLLCESLFMFRSLGRFVSHLPSRPHTHTRAHPAGQL

SEQ ID NO: 869648 - protein, 236 aa, Homo sapiens
GELVGVSAVSERAGRRLTGLQKQKDSMKDDRRSYCDSQVGLHRPAGPGAGHQEERAAVVAGRLQDVVAGEERGQQDGLCTVQLRGAEEQPEEGLPREEPEGHTSPATSPCPLKRQGRTNTSRCSSWTMSTALGSGASTPWTSWWNTTKRRPSSPASTGRSSTSSGPCSDGAPAPHSPPGPHGGAARPALWQRLLPRGRPRRLLCESLFMFRSLGRFVSHLPSRPHTHTRAHPAGQL

SEQ ID NO: 869649 - protein, 102 aa, Homo sapiens
MTEEVIVIAKWDYTAQQDQELDIKKNERLWLLDDSKTWWRVRNAANRTGYVPSNYVERKNSLKKGSLVKNLKDTLGECFTLERGSLVHFKETLFVFLVSLLF

SEQ ID NO: 869650 - protein, 380 aa, Homo sapiens; identical to SEQ ID NO: 869644

SEQ ID NO: 869651 - protein, 380 aa, Homo sapiens; identical to SEQ ID NO: 869644

SEQ ID NO: 869652 - protein, 324 aa, Homo sapiens
TLSNFATTGGSCQQPYFSHGLGKTRRKTSARDASPTPSTDAEYPANGSGADRIYDLNIPAFVKFAYVAEREDELSLVKGSRVTVMEKCSDGWWRGSYNGQIGWFPSNYVLEEVDEAAAESPSFLSLRKGASLSNGQGSRVLHVVQTLYPFSSVTEEELNFEKGETMEVIEKPENDPEWWKCKNARGQVGLVPKNYVVVLSDGPALHPAHAPQISYTGPSSSGRFAGREWYYGNVTRHQAECALNERGVEGDFLIRDSESSPSDFSVSLKASGKNKHFKVQLVDNVYCIGQRRFHTMDELVEHYKKAPIFTSEHGEKLYLVRALQ

SEQ ID NO: 869653 - protein, 380 aa, Homo sapiens; identical to SEQ ID NO: 869644

SEQ ID NO: 869654 - protein, 110 aa, Homo sapiens
MDILEPVFWGLRVCPCPLCCPLVTADGEREVVEGHKGSQGPDLQVANIISALFPLPRIFHWPTVLPGEIGVGQAEKYTTPVCSGRKYIVSALSGLSVYLLSSVVCFRTRI

SEQ ID NO: 869655 - protein, 193 aa, Homo sapiens
MPVTHRKSDASDMNSDTSPSCRLRAFSRGGSLESRSSSSRSRSFTLDDESLKYLTHEEKDVLLFFEETIDSLDEDFEEPVLCDGGVCCLCSPSLEESTSSPSEPEDVIDLVQPAPGAGEAEGLPEGTQAAGPAPAGKEHRKQDAETPPPPDPPAPETLLAPPPLPSTPDPPRRELRAPSPPVEHPRLLRSVPT

SEQ ID NO: 869656 - protein, 193 aa, Homo sapiens; identical to SEQ ID NO: 869655

SEQ ID NO: 869657 - protein, 50 aa, Homo sapiens
PVEHPRLLRSVPTPLVMAQKISERMAGNEALSPTSPFREGRPGEWRTPAA

SEQ ID NO: 869658 - protein, 43 aa, Homo sapiens
MQRFELRRWYLNPFEVQACCARLGRLLAVLGLEAAALPSCFQG

SEQ ID NO: 869659 - protein, 139 aa, Homo sapiens
MQSLLILTPSPVGCAPGRSDHTNGVPHRGAHTRRVTRGSRALCPRARAAPTRHGPNIRVTTPAPDESDQIPCRAITPMTRDSEWVGLEKPSTIYMCVCVCVCVCVCVCINACAWVCDPSSNTKTLCTGTLEPFQHEQQE

SEQ ID NO: 869660 - protein, 126 aa, Homo sapiens
ARYQGLQFVYLSFVYPNDYTRLTHMETDNKCFYRESPLYLERFGFYKYMKMAAPGEFTKFNSQVSKPRRLMASRRYYFELLHKQDDRGSDHVEVGWRAFLPGLKFEAFSSSSHPTFPRLALGWDLE

SEQ ID NO: 869661 - protein, 2101 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869662 - protein, 2014 aa, Homo sapiens
MLTPHRELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869663 - protein, 2119 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITRHKALMTIIPDLSPNNPLSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869664 - protein, 1068 aa, Homo sapiens
EILTLTESPTSDRVPTSDRVSLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869665 - protein, 876 aa, Homo sapiens
EQREGRISRRSIGKQNDTTGHAKTARCPVELGREAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869666 - protein, 297 aa, Homo sapiens [sequence omitted]

SEQ ID NO: 869667 - protein, 2115 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869668 - protein, 2097 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869669 - protein, 271 aa, Homo sapiens
MLKAIDWRRSACLEKLELLSYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869670 - protein, 2114 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKQA

SEQ ID NO: 869671 - protein, 1763 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITRSGGSLPPYVCLWSACCLSGCILVR

SEQ ID NO: 869672 - protein, 2115 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKAPTCMTPSRIAPPAARTLRHCHLDQASKHKAVHDAHYPMD

SEQ ID NO: 869673 - protein, 1749 aa, Homo sapiens [sequence omitted]

SEQ ID NO: 869674 - protein, 1749 aa, Homo sapiens [sequence omitted]

SEQ ID NO: 869675 - protein, 1730 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVRIWLADSPHSYSTGPLCPLLLGHCCLRLFFTLPLALSFSGCPCRPAASRPGQIPGGN

SEQ ID NO: 869676 - protein, 417 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKVTLCWGHSHSLDHMCKAESSLPLCSSGPLGIKLLSLQGSIVCCN

SEQ ID NO: 869677 - protein, 307 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADDSFLLASGLMILTFWNSSVSLLCNLTALTSSPGFTKECPPSLQDVWGHAEKGPPQADEPVMIESRTCGIGAMSLSITSALMT

SEQ ID NO: 869678 - protein, 139 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVIRKFVLDQSD

SEQ ID NO: 869679 - protein, 2101 aa, Homo sapiens; identical to SEQ ID NO: 869661

SEQ ID NO: 869680 - protein, 2115 aa, Homo sapiens; identical to SEQ ID NO: 869667

SEQ ID NO: 869681 - protein, 979 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869682 - protein, 2086 aa, Homo sapiens
VVSSWPVVALGLSVAYGYTWVPRHRIRPHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869683 - protein, 1749 aa, Homo sapiens [sequence omitted]

SEQ ID NO: 869684 - protein, 995 aa, Homo sapiens
MAPRWANAPCKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869685 - protein, 1749 aa, Homo sapiens [sequence omitted]

SEQ ID NO: 869686 - protein, 2115 aa, Homo sapiens; identical to SEQ ID NO: 869667

SEQ ID NO: 869687 - protein, 305 aa, Homo sapiens
RHRLAVVGTWITVSVLAWECANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869688 - protein, 251 aa, Homo sapiens
MAIKRLSSLPGDRCYHSQFCSTVPRRRCPERPLRRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 869689 - protein, 1775 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSQANSSQTPRDSDACPHPGLVPGPSLAPSRSWPRGPGAWTVWALSLPCLLFS

SEQ ID NO: 869690 - protein, 1730 aa, Homo sapiens; identical to SEQ ID NO: 869675

SEQ ID NO: 869691 - protein, 345 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLAPELAARP

SEQ ID NO: 869692 - protein, 90 aa, Homo sapiens
MDVPWDLRASEGNGKLLYSARDCTLQQIHSVFQKLDVEEPDSANSSFYSTRSAPASQASLRATSSTQSLARLGSPDYGNSALLSLPGYRP

SEQ ID NO: 869693 - protein, 277 aa, Homo sapiens
ANKAHTGQGSCWVATLASAMIPPADSLLKYDTPVLVSRNTEKRSPKARLLKVSPQQPGPSGSAPQPPKTKLPSTPCVPDPTKQAEEILNAILPPREWVEDTQLWIQQVSSTPSTRMDVVHLQEQLDLKLQQRQARETGICPVRRELYSQCFDELIREVTINCAERGLLLLRVRDEIRMTIAAYQTLYESSVAFGMRKALQAEQGKSDMERKIAELETEKRDLERQVNEQKAKCEATEKRESERRQVEEKKHNEEIQFLKRTNQQLKAQLEGIIAPKK

SEQ ID NO: 869694 - protein, 93 aa, Homo sapiens
RERKVGPGDRHSAYGGPAPALVSEFPQYFIDYYFHYLSKRQVNEQKAKCEATEKRESERRQVEEKKHNEEIQFLKRTNQQLKAQLEGIIAPKK

SEQ ID NO: 869695 - protein, 165 aa, Homo sapiens
PLKCTLLYLQEQLDLKLQQRQARETGICPVRRELYSQCFDELIREVTINCAERGLLLLRVRDEIRMTIAAYQTLYESSVAFGMRKALQAEQGKSDMERKIAELETEKRDLERQVNEQKAKCEATEKRESERRQVEEKKHNEEIQFLKRTNQQLKAQLEGIIAPKK

SEQ ID NO: 869696 - protein, 70 aa, Homo sapiens
EKRESERRQVEEKKHNEEIQFLKRTNQQLKVINAQGGVEVPPALRPSPTGQAFGSFSMAFKCLSTCTAKG

SEQ ID NO: 869697 - protein, 95 aa, Homo sapiens
ANKAHTGQGSCWVATLASAMIPPADSLLKYDTPVLVSRNTEKRSPKARLLKVSPQQPGPSGSAPQPPKTKLPSTPCVPDPTKQAEEILNAILPPR

SEQ ID NO: 869698 - protein, 132 aa, Homo sapiens
MPYYPQDELIREVTINCAERGLLLLRVRDEIRMTIAAYQTLYESSVAFGMRKALQAEQGKSDMERKIAELETEKRDLERQVNEQKAKCEATEKRESERRQVEEKKHNEEIQFLKRTNQQLKAQLEGIIAPKK

SEQ ID NO: 869699 - protein, 390 aa, Homo sapiens
MLPGVGVFGTSLTARVIIPLLKDEGFAVKALWGRTQEEAEELAKEMSVPFYTSRIDEVLLHQDVDLVCINLPPPLTRQIAVKTLGIGKNVICDRTATPLDAFRMTSAAHYYPKLMSIMGNVLRFLPAFVRMKQLIEEGYVGEPLVCEVQVHGGSLLGKKYNWSCDDLMGGGGLHSVGTYIIDLLTFLTGQKAVKVHGLLKTFVKQTDHIKGIRQITSDDFCTFQMVLEGGVCCTVTLNFNVPGEFKQDVTVVGSAGRLLAVGTDLYGQRNSAPEQELLVQDATPVSNSLLPEKAFSDIPSPYLRGTIKMMQAVRQAFQDQDDRRTWDGRPLTMAATFDDCLYALCVVDTIKRSSQTGEWQNIAIMTEEPELSPAYLISEAMRRSRMSLYC

SEQ ID NO: 869700 - protein, 134 aa, Homo sapiens
MGDSRRDVLHEPAIALLSSPQTQSRLQIDAFIARRCWGSQWDITGYIHQQDFPTAVFIGFSNEFNICIPHPFTEWLQCVRKYSQSWGVRKGPKAYKIWHVLWRELIIYPEPTHHFWNEKRTSFYGGLTMCQIVV

SEQ ID NO: 869701 - protein, 148 aa, Homo sapiens
MLPGVGVFGTSLTARVIIPLLKDEGFAVKALWGRTQEEAEELAKEMSVPFYTSRIDEVLLHQDVDLVCINLPPPLTRQIAVKTLEPGHQRKKISRQKNTGEKKMPRGSVQLSFCSLQHPHMGHLFTPHDAALGESQGTGFKPLGMQPV

SEQ ID NO: 869702 - protein, 287 aa, Homo sapiens
MTSAAHYYPKLMSIMGNVLRFLPAFVRMKQLIEEGYVGEPLVCEVQVHGGSLLGKKYNWSCDDLMGGGGLHSVGTYIIDLLTFLTGQKAVKVHGLLKTFVKQTDHIKGIRQITSDDFCTFQMVLEGGVCCTVTLNFNVPGEFKQDVTVVGSAGRLLAVGTDLYGQRNSAPEQELLVQDATPVSNSLLPEKAFSDIPSPYLRGTIKMMQAVRQAFQDQDDRRTWDGRPLTMAATFDDCLYALCVVDTIKRSSQTGEWQNIAIMTEEPELSPAYLISEAMRRSRMSLYC

SEQ ID NO: 869703 - protein, 168 aa, Homo sapiens
MLPGVGVFGTSLTARVIIPLLKDEGFAVKALWGRTQEEAEELAKEMSVPFYTSRIDEVLLHQDVDLVCINLPPPLTRQIAVKTLDVILQFSRTRAPWGQVPGWNLSCLSCLEIPTRKAGTRPRLDCQPHTGHTPPLLAPVLDGSGCQATRLSALSRLLSRYRRQACNS

SEQ ID NO: 869704 - protein, 217 aa, Homo sapiens
MPVRTECPPPAGASAASAASLIPPPPINTQQPGVATSLLYSGSKFRGHQKSKGNSYDVEVVLQHVDTGNSYLCGYLKIKGLTEEYPTLTTFFEGEIISKKHPFLTRKWDADEDVDRKHWGKFLAFYQYAKSFNSDDFDYEELKNGDYVFMRWKEQFLVPDHTIKDISGASFAGFYYICFQKSAASIEGYYYHRSSEWYQSLNLTHVPEHSAPIYEFR

SEQ ID NO: 869705 - protein, 217 aa, Homo sapiens; identical to SEQ ID NO: 869704

SEQ ID NO: 869706 - protein, 243 aa, Homo sapiens
GTEAGCFVRGGVPLPLPPALAPGDPAMPVRTECPPPAGASAASAASLIPPPPINTQQPGVATSLLYSGSKFRGHQKSKGNSYDVEVVLQHVDTGNSYLCGYLKIKGLTEEYPTLTTFFEGEIISKKHPFLTRKWDADEDVDRKHWGKFLAFYQYAKSFNSDDFDYEELKNGDYVFMRWKEQFLVPDHTIKDISGASFAGFYYICFQKSAASIEGYYYHRSSEWYQSLNLTHVPEHSAPIYEFR

SEQ ID NO: 869707 - protein, 236 aa, Homo sapiens
MPVRTECPPPAGASAASAASLIPPPPINTQQPGVATSLLYSGSKFRGHQKSKGNSYDVEVVLQHVDTGNSYLCGYLKIKGLTEEYPTLTTFFEGEIISKKHPFLTRKWDADEDVDRKHWNIGRYLDLQTLLDWTETFWGKFLAFYQYAKSFNSDDFDYEELKNGDYVFMRWKEQFLVPDHTIKDISGASFAGFYYICFQKSAASIEGYYYHRSSEWYQSLNLTHVPEHSAPIYEFR

SEQ ID NO: 869708 - protein, 105 aa, Homo sapiens
MLIEKHWGKFLAFYQYAKSFNSDDFDYEELKNGDYVFMRWKEQFLVPDHTIKDISGASFAGFYYICFQKSAASIEGYYYHRSSEWYQSLNLTHVPEHSAPIYEFR

SEQ ID NO: 869709 - protein, 197 aa, Homo sapiens
MPVRTECPPPAGASAASAASLIPPPPINTQQPGVATSLLYSGSKFRGHQKSKGNSYDVEVVLQHVDTGNSYLCGYLKIKGLTEEYPTLTTFFEGEIISKKHPFLTRKWDADEDVDRKHWGKFLAFYQYAKSFNSDDFDYEELKNGDYVFMRWKEQFLVPDHTIKDISGASFAGFYYICFQKSAASIEGYYYHRSSEW

SEQ ID NO: 869710 - protein, 1203 aa, Homo sapiens
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQSQRRVTFHLPDGSQESCSDSGLGDHEPVGSGTLISHPLPLVQPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 869711 - protein, 102 aa, Homo sapiens
MTRPLRTRGLKQMATLIPTLVSPLQNFDCLELFWFCSALELSKIIVGGKDEHLVIFLLALLLLLYSLRYTFNMFDMILAVKLYDVSSFYEPLKKKKTCYKYN

SEQ ID NO: 869712 - protein, 1180 aa, Homo sapiens
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQKCPSSTGFHIQENEESHYEPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 869713 - protein, 1032 aa, Homo sapiens
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQVNEHFYWSISTAYKCPVNQY

SEQ ID NO: 869714 - protein, 1138 aa, Homo sapiens
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQKCPSSTGFHIQENEESHYEPQDEFYDQASPDKRTEADGNSDPNSGESPSNFDCLELFWFCSALELSKIIVGGKDEHLVIFLLALLLLLYSLRYTFNMFDMILAVKLYDVSSFYEPLKKKKTCYKYN

SEQ ID NO: 869715 - protein, 68 aa, Homo sapiens
MVYYPELFVWVSQEPFPNKDMEGRLPKGRLPVPKEVNRKKNDETNAASLTPLGSSELRSPRISYLHFF

SEQ ID NO: 869716 - protein, 77 aa, Homo sapiens
RFVSPGRRAVQWGRRGERGARGAGAGCRGARACWPLADGAQSRRFLPSVERRESEQGAGLLSVGLPGLKRGRIEAQD

SEQ ID NO: 869717 - protein, 115 aa, Homo sapiens
FPLSLRVSLSLSLSLPPICLSSMLPFFNHICVSGVERRESEQGAGLLSVYYPELFVWVSQEPFPNKDMEGRLPKGRLPVPKEVNRKKNDETNAASLTPLGSSELRSPRISYLHFF

SEQ ID NO: 869718 - protein, 115 aa, Homo sapiens; identical to SEQ ID NO: 869717

SEQ ID NO: 869719 - protein, 77 aa, Homo sapiens; identical to SEQ ID NO: 869716

SEQ ID NO: 869720 - protein, 77 aa, Homo sapiens; identical to SEQ ID NO: 869716

SEQ ID NO: 869721 - protein, 101 aa, Homo sapiens
MPTGVIVIRETAVAWSTSLPKESHRPPPDSTVALAPAYEVFPITGPLLLGHSWTVMFFKFFLFIKSEGILLFLLMDVRKSLLPCDCPVKYLTAFMCFPNLL

SEQ ID NO: 869722 - protein, 74 aa, Homo sapiens
PTRTPTRRGERVNRERGFVCWSPWTEERENRSPRLRFSKWFITQNSLSGSVKNHFQTRTWREGFLREDFLSQRK

SEQ ID NO: 869723 - protein, 77 aa, Homo sapiens; identical to SEQ ID NO: 869716

SEQ ID NO: 869724 - protein, 115 aa, Homo sapiens; identical to SEQ ID NO: 869717

SEQ ID NO: 869725 - protein, 39 aa, Homo sapiens
MVYYPELFVWVSQEPFPNKDMEGRLPKKLPPKEVPQETD

SEQ ID NO: 869726 - protein, 66 aa, Homo sapiens
MSSTTQTPTALTQPVHSCLFTHTAPDCFLQRLRVPPPPFFSFRCNKPSSLCSSIVCISLYFIHVLF

SEQ ID NO: 869727 - protein, 216 aa, Homo sapiens
MGWIRGRRSRHSWEMSEFHNYNLDLKKSDFSTRWQKQRCPVVKSKCRENASPFFFCCFIAVAMGIRFIIMVAIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 869728 - protein, 216 aa, Homo sapiens; identical to SEQ ID NO: 869727

SEQ ID NO: 869729 - protein, 141 aa, Homo sapiens [sequence omitted]

SEQ ID NO: 869730 - protein, 216 aa, Homo sapiens; identical to SEQ ID NO: 869727

SEQ ID NO: 869731 - protein, 121 aa, Homo sapiens
ENLNFRENLPSHFKFKEYCPQVFRNLRDRFGIDDQDYLVSLTRNPPSESEGSDGRFLISYDRTLVIKEVSSEESTSMTQTSPTRLTCLTPHWGSNFHMSIGWGQTKSKHSISRSSKGKSQR

SEQ ID NO: 869732 - protein, 399 aa, Homo sapiens
MAKSIQAWGKMFDIAALHQNLTPLLGLEPFSGASLPINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQYIVKCHGNTLLPQFLGMYRVSVDNEDSYMLVMRNMFSHRLPVHRKYDLKGSLVSREASDKEKVKELPTLKDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 869733 - protein, 421 aa, Homo sapiens
MASSSVPPATVSAATAGPGPGFGFASKTKKKHFVQQKVKVFRAADPLVGVFLWGVAHSINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQYIVKCHGNTLLPQFLGMYRVSVDNEDSYMLVMRNMFSHRLPVHRKYDLKGSLVSREASDKEKVKELPTLKDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 869734 - protein, 187 aa, Homo sapiens
MAKSIQAWGKMFDIAALHQNLTPLLGLEPFSGASLPINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQVRPLSSPILSLSSLLTYSSAIVSNRCQLGRKLIGRENP

SEQ ID NO: 869735 - protein, 421 aa, Homo sapiens; identical to SEQ ID NO: 869733

SEQ ID NO: 869736 - protein, 143 aa, Homo sapiens [sequence omitted]

SEQ ID NO: 869737 - protein, 199 aa, Homo sapiens
ILPDYILPKEKVKELPTLKDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 869738 - protein, 392 aa, Homo sapiens
MITLITEQLQKQTLDELKCTRFSISLPLPDHADISNCGNSFQLVSEGASWRGLPHCSCAEFQDSLNFSYHPSGLSLHLRPPSRGNSPKEQPFSQVLRPEPPDPEKLPVPPAPPSKRHCRSLSVPVDLSRWQPVWRPAPSKLWTPIKHRGSGGGGGPQVPHQSPPKRVSSLRFLQAPSASSQCAPAHRPYSPPFFSLALAQDSSRPCAASPQSGSWESDAESLSPCPPQRRFSLSPSLGPQASRFLPSARSSPASSPELPWRPRGLRNLPRSRSQPCDLDARKTGVKRRHEEDPRRLRPSLDFDKMNQKPYSGGLCLQETAREGSSISPPWFMACSPPPLSASCSPTGGSSQVLSESEEEEEGAVRWGRQALSKRTLCQRDFGDLDLNLIEEN

SEQ ID NO: 869739 - protein, 170 aa, Homo sapiens
ELLRPRPWELEEPRLGPQASRFLPSARSSPASSPELPWRPRGLRNLPRSRSQPCDLDARKTGVKRRHEEDPRRLRPSLDFDKMNQKPYSGGLCLQETAREGSSISPPWFMACSPPPLSASCSPTGGSSQVLSESEEEEEGAVRWGRQALSKRTLCQRDFGDLDLNLIEEN

SEQ ID NO: 869740 - protein, 392 aa, Homo sapiens; identical to SEQ ID NO: 869738

SEQ ID NO: 869741 - protein, 392 aa, Homo sapiens; identical to SEQ ID NO: 869738

SEQ ID NO: 869742 - protein, 392 aa, Homo sapiens; identical to SEQ ID NO: 869738

SEQ ID NO: 869743 - protein, 392 aa, Homo sapiens; identical to SEQ ID NO: 869738

SEQ ID NO: 869744 - protein, 356 aa, Homo sapiens
MYSYYKCLPEGASWRGLPHCSCAEFQDSLNFSYHPSGLSLHLRPPSRGNSPKEQPFSQVLRPEPPDPEKLPVPPAPPSKRHCRSLSVPVDLSRWQPVWRPAPSKLWTPIKHRGSGGGGGPQVPHQSPPKRVSSLRFLQAPSASSQCAPAHRPYSPPFFSLALAQDSSRPCAASPQSGSWESDAESLSPCPPQRRFSLSPSLGPQASRFLPSARSSPASSPELPWRPRGLRNLPRSRSQPCDLDARKTGVKRRHEEDPRRLRPSLDFDKMNQKPYSGGLCLQETAREGSSISPPWFMACSPPPLSASCSPTGGSSQVLSESEEEEEGAVRWGRQALSKRTLCQRDFGDLDLNLIEEN

SEQ ID NO: 869745 - protein, 173 aa, Homo sapiens
MITLITEQLQKQTLDELKCTRFSISLPLPDHADISNCGNSFQLVSEGASWRGLPHCSCAEFQDSLNFSYHPSGLSLHLRPPSRGNSPKEQPFSQVLRPEPPDPEKLPVPPAPPSKRHCRSLSVPVDLSRWQPVWRPAPSKLWTPIKHRGSGGGGGPQVPHQIPKAGGRAWEWG

SEQ ID NO: 869746 - protein, 392 aa, Homo sapiens; identical to SEQ ID NO: 869738

SEQ ID NO: 869747 - protein, 392 aa, Homo sapiens; identical to SEQ ID NO: 869738

SEQ ID NO: 869748 - protein, 115 aa, Homo sapiens
MWAFLCSPCLGLPPSGSWQDLKDHMREAGDVCYADVQKDGVGMVEYLRKEDMEYALRKLDDTKFRSHEGETSYIRVYPERSTSYGYSRSRSGSRGRDSPYQSRGSPHYFSPFRPY

SEQ ID NO: 869749 - protein, 221 aa, Homo sapiens
MSGWADERGGEGDGRIYVGNLPTDVREKDLEDLFYKYGRIREIELKNRHGLVPFAFVRFEDPRDAEDAIYGRNGYDYGQCRLRVEFPRTYGGRGGWPRGGRNGPPTRRSDFRVLVSGLPPSGSWQDLKDHMREAGDVCYADVQKDGVGMVEYLRKEDMEYALRKLDDTKFRSHEGETSYIRVYPERSTSYGYSRSRSGSRGRDSPYQSRGSPHYFSPFRPY

SEQ ID NO: 869750 - protein, 221 aa, Homo sapiens; identical to SEQ ID NO: 869749

SEQ ID NO: 869751 - protein, 221 aa, Homo sapiens; identical to SEQ ID NO: 869749

SEQ ID NO: 869752 - protein, 190 aa, Homo sapiens
MSGWADERGGEGDGRIYVGNLPTDVREKDLEDLFYKYGRIREIELKNRHGLVPFAFVRFEDPRDAEDAIYGRNGYDYGQCRLRVEFPRTYGGRGGWPRGGRNGPPTRRSDFRVLVSGLPPSGSWQDLKDHMREAGDVCYADVQKDGVGMVEYLRKEDMEYALRKLDDTKFRSHEVGPCLLLRSLYSNHST

SEQ ID NO: 869753 - protein, 125 aa, Homo sapiens
MSGWADERGGEGDGRIYVGNLPTDVREKDLEDLFYKYGRIREIELKNRHGLVPFAFVRFEDPRDAEDAIYGRNGYDYGQCRLRVEFPRTYGGRGGWPRGGRNGPPTRRSDFRVLVSGMFLSNRMR

SEQ ID NO: 869754 - protein, 160 aa, Homo sapiens
MSGWADERGGEGDGRIYVGNLPTDVREKDLEDLFYKYGRIREIELKNRHGLVPFAFVRFEDPREAPAPLPSPPRCLRPPPSLLSPPPGLPSPRPPLPPPPRRPLTAPPHGWRMRQPLLAGPGRPSRRRHFLYFYYSNILLRNPKAEPLEGPSPPAPASGG

SEQ ID NO: 869755 - protein, 182 aa, Homo sapiens
PAQAVSSINSILVHFAFVPCEDPRDAEDAIYGRNGYDYGQCRLRVEFPRTYGGRGGWPRGGRNGPPTRRSDFRVLVSGLPPSGSWQDLKDHMREAGDVCYADVQKDGVGMVEYLRKEDMEYALRKLDDTKFRSHEGETSYIRVYPERSTSYGYSRSRSGSRGRDSPYQSRGSPHYFSPFRPY

SEQ ID NO: 869756 - protein, 221 aa, Homo sapiens; identical to SEQ ID NO: 869749

SEQ ID NO: 869757 - protein, 159 aa, Homo sapiens
MSGWADERGGEGDGRIYVGNLPTDVREKDLEDLFYKYGRIREIELKNRHGLVPFAFVRFEDPRDAEDAIYGRNGYDYGQCRLRVEFPRTYGGRGGWPRGGRNGPPTRRSDFRVLVSGLPPSGSWQDLKDHMREAGDVCYADVQKDGVGMVEYLRKEDMG

SEQ ID NO: 869758 - protein, 125 aa, Homo sapiens; identical to SEQ ID NO: 869753

SEQ ID NO: 869759 - protein, 82 aa, Homo sapiens
TGTPQPALGPSGPWAVGPRAADMWLKWRRRRGLEAEGLVVLKTRGRRARLPGRRPAPLGNRELLAAGWGPSSQWRPPPCLLA

SEQ ID NO: 869760 - protein, 104 aa, Homo sapiens
MKSEFYTTTSSVVGPRGSSKAVPKAKLAPKKKGPWSTGSRGSCLPPFWIPTYKVFPWKSLGWNPFTNSWKRSLFQGKIGLKWPPPEKKPWPLTLGLWPLGQFGG

SEQ ID NO: 869761 - protein, 83 aa, Homo sapiens
PSLTRSRLAPAFLLFFYPPLQKKRRLGCDGRQRRTRSGGVKIPAEKEEGTAGGRRRRIRRKGARPAGAISVENKMAALAEGQL

SEQ ID NO: 869762 - protein, 77 aa, Homo sapiens
PKRPRSGSRVCGGRPPARRAGRGEPGLPVSADGGSPGAAGSRGSGRETRRREYAFCLMMLDKKQIWSSFLIRVQNGS

SEQ ID NO: 869763 - protein, 118 aa, Homo sapiens
MGKMSPSTITVKSVLVAGMLPLGMLCLEETGQAGTGQGLTPSTQDDHEPSKCPTSHLGSPACFTSVRAEGTFFCFLKVEGLMLWKTDEKALPEKRGEDSGKLMLTGRSVTERSHMEGR

SEQ ID NO: 869764 - protein, 521 aa, Homo sapiens
MVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 869765 - protein, 273 aa, Homo sapiens
WYGRRVWDLAQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVACPRHSCLQI

SEQ ID NO: 869766 - protein, 521 aa, Homo sapiens; identical to SEQ ID NO: 869764

SEQ ID NO: 869767 - protein, 527 aa, Homo sapiens
MVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSPLFFCSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 869768 - protein, 562 aa, Homo sapiens
VIRGSFLAQTRMDVTLLECRDRVGGRVATFRKGNYVADLGAMVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 869769 - protein, 521 aa, Homo sapiens; identical to SEQ ID NO: 869764

SEQ ID NO: 869770 - protein, 199 aa, Homo sapiens
MGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 869771 - protein, 199 aa, Homo sapiens; identical to SEQ ID NO: 869770

SEQ ID NO: 869772 - protein, 417 aa, Homo sapiens
MVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDTWIPEHPIKTQHHLVRLPNPILWTADVW

SEQ ID NO: 869773 - protein, 376 aa, Homo sapiens
SRRGGSALGACVRDGGWRRAGSVKRGEARLFGPTERQSERPLRPSAARRPEMLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARIVWVDELPHFAKETM

SEQ ID NO: 869774 - protein, 332 aa, Homo sapiens
SRRGGSALGACVRDGGWRRAGSVKRGEARLFGPTERQSERPLRPSAARRPEMLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPSKDLLPG

SEQ ID NO: 869775 - protein, 521 aa, Homo sapiens; identical to SEQ ID NO: 869764

SEQ ID NO: 869776 - protein, 521 aa, Homo sapiens; identical to SEQ ID NO: 869764

SEQ ID NO: 869777 - protein, 199 aa, Homo sapiens; identical to SEQ ID NO: 869770

SEQ ID NO: 869778 - protein, 175 aa, Homo sapiens
RYRLKANSARLGVIFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 869779 - protein, 376 aa, Homo sapiens; identical to SEQ ID NO: 869773

SEQ ID NO: 869780 - protein, 376 aa, Homo sapiens; identical to SEQ ID NO: 869773

SEQ ID NO: 869781 - protein, 376 aa, Homo sapiens; identical to SEQ ID NO: 869773

SEQ ID NO: 869782 - protein, 376 aa, Homo sapiens; identical to SEQ ID NO: 869773

SEQ ID NO: 869783 - protein, 241 aa, Homo sapiens
SRRGGSALGACVRDGGWRRAGSVKRGEARLFGPTERQSERPLRPSAARRPEMLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKTIPLPLNLRPTLGSCLAPLFLSFHIPSTSTALLVHQMRPQM

SEQ ID NO: 869784 - protein, 912 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 869785 - protein, 878 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 869786 - protein, 897 aa, Homo sapiens [sequence omitted]

SEQ ID NO: 869787 - protein, 800 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHR

SEQ ID NO: 869788 - protein, 657 aa, Homo sapiens [sequence omitted]

SEQ ID NO: 869789 - protein, 642 aa, Homo sapiens
LLLEAPGLLKRCGMGVVFHCSQLGLPFAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 869790 - protein, 1235 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFMGHEWVWLDSEQDHPNDSELSNDCRSLFSSWDSSLDLDVGNWRETEDPEAEELEESSPEREPSELLVGDGGSEESQEAARKASHQNLLHFLSEVAYLMEPLCISSNESSEGCCPPSGTRQEGREIKASEGERELCRETEELSAKGDPLVAEKPLGENGKPEVASAPSVICTVQGLLTESEEGEAQQESKGEDQGEVYVSEMEDQPPSGECDDAFNIKETPLVDTLFSHATSSKLTDLSQDDPVQDHLLFKKTLLPVWKMIASHRFSSPFLKPVSERQAPGYKDVVKRPMDLTSLKRNLSKGRIRTMAQFLRDLMLMFQNAVMYNDSDHHVYHMAVEMRREVLEQIQVLNIWLDKRKGSSSLEGEPANPVDDGKPVF

SEQ ID NO: 869791 - protein, 969 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFTAKYCTRGRSWAAGREQQMERSLLIVLISWKTTVRRC

SEQ ID NO: 869792 - protein, 932 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLF

SEQ ID NO: 869793 - protein, 1303 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFMGHEWVWLDSEQDHPNDSELSNDCRSLFSSWDSSLDLDVGNWRETEDPEAEELEESSPEREPSELLVGDGGSEESQEAARKASHQNLLHFLSEVAYLMEPLCISSNESSEGCCPPSGTRQEGREIKASEGERELCRETEELSAKGDPLVAEKPLGENGKPEVASAPSVICTVQGLLTESEEGEAQQESKGEDQGEVYVSEMEDQPPSGECDDAFNIKETPLVDTLFSHATSSKLTDLSQDDPVQDHLLFKKTLLPVWKMIASHRFSSPFLKPVSERQAPGYKDVVKRPMDLTSLKRNLSKGRIRTMAQFLRDLMLMFQNAVMYNDSDHHVYHMAVEMRREVLEQIQVLYADTCSLWNLDFRTPMRIKVISR

SEQ ID NO: 869794 - protein, 970 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFNKTNKYPRLQDYFIFHRFACTGITSEIVCTWFQTIAIK

SEQ ID NO: 869795 - protein, 711 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGPEETRRDPLE

SEQ ID NO: 869796 - protein, 127 aa, Homo sapiens
MDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 869797 - protein, 348 aa, Homo sapiens [sequence omitted]

SEQ ID NO: 869798 - protein, 953 aa, Homo sapiens
GTRATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 869799 - protein, 951 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 869800 - protein, 881 aa, Homo sapiens
MRTTERDQKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 869801 - protein, 683 aa, Homo sapiens
SESLEDLIICSMADGLLDLDFPVSLQVITPSFSLIPNLVTIRFYFSGIIKITGSTCCNMVGSKYEAPRAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 869802 - protein, 932 aa, Homo sapiens; identical to SEQ ID NO: 869792

SEQ ID NO: 869803 - protein, 254 aa, Homo sapiens
SDSLKEIYMPQCEDDRCVSLPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 869804 - protein, 509 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPIQSLT

SEQ ID NO: 869805 - protein, 275 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVNESEMAVASGHLNSTGVLLEVGGVLPMIHGGEIQQTPNTVAASPAASGKLPLFLYQPQRC

SEQ ID NO: 869806 - protein, 2414 aa, Homo sapiens
PLSSQPQPLATRRAEHRSRKPPTTMSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQGRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 869807 - protein, 2407 aa, Homo sapiens
GTEAGSRETSSAVSLEEGSRVSGIRILEEKQNRTRSRKPPTTMSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQGRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEVSCPSCSSLSVPFQKLPAADSPSFPVLPLFPGLVLCGKTGCVRRPHQAALPV

SEQ ID NO: 869808 - protein, 197 aa, Homo sapiens
MPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 869809 - protein, 2341 aa, Homo sapiens
GTEAGSRETSSAVSLEEGSRVSGIRILEEKQNRTRSRKPPTTMSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQGRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLG

SEQ ID NO: 869810 - protein, 1669 aa, Homo sapiens
GTEAGSRETSSAVSLEEGSRVSGIRILEEKQNRTRSRKPPTTMSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQGRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELLLPRLE

SEQ ID NO: 869811 - protein, 2432 aa, Homo sapiens
GTEAGSRETSSAVSLEEGSRVSGIRILEEKQNRTRSRKPPTTMSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQGRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 869812 - protein, 2407 aa, Homo sapiens; identical to SEQ ID NO: 869807

SEQ ID NO: 869813 - protein, 109 aa, Homo sapiens
HEAAKTAENESSQLPPSVQETARDSRQGPPSCQDNCLLLGSVAKVNPSPGTVTGDESMFPRAALLFCCLIPDWWWDPGNPLSHPRRLLPFPQPRASVPHHGVDSAAPST

SEQ ID NO: 869814 - protein, 470 aa, Homo sapiens
MAATLLMAGSQAPVTFEDMAMYLTREEWRPLDAAQRDLYRDVMQENYGNVVSLDFEIRSENEVNPKQEISEDVQFGTTSERPAENAEENPESEEGFESGDRSERQWGDLTAEEWVSYPLQPVTDLLVHKEVHTGIRYHICSHCGKAFSQISDLNRHQKTHTGDRPYKCYECGKGFSRSSHLIQHQRTHTGERPYDCNECGKSFGRSSHLIQHQTIHTGEKPHKCNECGKSFCRLSHLIQHQRTHSGEKPYECEECGKSFSRSSHLAQHQRTHTGEKPYECNECGRGFSERSDLIKHYRVHTGERPYKCDECGKNFSQNSDLVRHRRAHTGEKPYHCNECGENFSRISHLVQHQRTHTGEKPYECNACGKSFSRSSHLITHQKIHTGEKPYECNECWRSFGERSDLIKHQRTHTGEKPYECVQCGKGFTQSSNLITHQRVHTGEKPYECTECEKSFSRSSALIKHKRVHTD

SEQ ID NO: 869815 - protein, 470 aa, Homo sapiens; identical to SEQ ID NO: 869814

SEQ ID NO: 869816 - protein, 192 aa, Homo sapiens
MAATLLMAGSQAPVTFEDMAMYLTREEWRPLDAAQRDLYRDVMQENYGNVVSLDFEIRSENEVNPKQEISEDVQFGTTSERPAENAEENPESEEGFESGDRSERQWGDLTAEEWVSYPLQPVTDLLVHKEVHTGIRYHICSHCGKAFSQISDLNRHQKTHTGDRPYKCYECGKGFSRSSHLIQHSSQQGYRA

SEQ ID NO: 869817 - protein, 470 aa, Homo sapiens; identical to SEQ ID NO: 869814

SEQ ID NO: 869818 - protein, 362 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAVTDSAQGSGVSLTANKV

SEQ ID NO: 869819 - protein, 389 aa, Homo sapiens
MAPRSLLLLLSGALALTDTWAGECGVQRETASVGRSEGPARWGRRTQGAAPEEGLAGLSPSSPPGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAV

SEQ ID NO: 869820 - protein, 353 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAGKMKEADP

SEQ ID NO: 869821 - protein, 369 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSGPAPECLYLSNKYSHPGAIFPPEDISYVWKNVLLP

SEQ ID NO: 869822 - protein, 353 aa, Homo sapiens; identical to SEQ ID NO: 869820

SEQ ID NO: 869823 - protein, 338 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSGRKG

SEQ ID NO: 869824 - protein, 442 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 869825 - protein, 346 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAV

SEQ ID NO: 869826 - protein, 338 aa, Homo sapiens; identical to SEQ ID NO: 869823

SEQ ID NO: 869827 - protein, 338 aa, Homo sapiens; identical to SEQ ID NO: 869823

SEQ ID NO: 869828 - protein, 431 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 869829 - protein, 216 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPGHSARGVLLG

SEQ ID NO: 869830 - protein, 123 aa, Homo sapiens
KQREPLQKGEPGSVPLGHHDLTALLLPSWFHGKITREQAERLLYPPETGLFLVRESTNYPGDYTLCVSCDGKVEHYRIMYHASKLSIDEEVYFENLMQLVEHYTSDQMDSVALHDLWFNEAST

SEQ ID NO: 869831 - protein, 450 aa, Homo sapiens
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 869832 - protein, 450 aa, Homo sapiens; identical to SEQ ID NO: 869831

SEQ ID NO: 869833 - protein, 475 aa, Homo sapiens
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGGELGRAPGGVLRDSELGNKTTSLPPDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 869834 - protein, 211 aa, Homo sapiens
MTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 869835 - protein, 163 aa, Homo sapiens
AIAGLVMTRNMRSEQDTCMGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 869836 - protein, 97 aa, Homo sapiens
SCEGVIQGPRAFEERSLASGWHVCRDVLFIGELGALHPLRSSCSSLCIGSGARKKQKMFPFTTAGGPDPKRLSHTEWPSARVGNFGDRMQLPPNKYR

SEQ ID NO: 869837 - protein, 450 aa, Homo sapiens; identical to SEQ ID NO: 869831

SEQ ID NO: 869838 - protein, 434 aa, Homo sapiens
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGTCGWPTPRDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 869839 - protein, 60 aa, Homo sapiens
MEYLEGNNFVHRDLAARNVLVSEDNVAKVSDFGLTKEASSTQDTGKLPVKWTAPEALREK

SEQ ID NO: 869840 - protein, 289 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGEEHPPHCWAPGQEQCPRHLQRLPRLLQRLLLQLSSAEGGARLPEVFPDRQL

SEQ ID NO: 869841 - protein, 289 aa, Homo sapiens; identical to SEQ ID NO: 869840

SEQ ID NO: 869842 - protein, 289 aa, Homo sapiens; identical to SEQ ID NO: 869840

SEQ ID NO: 869843 - protein, 289 aa, Homo sapiens; identical to SEQ ID NO: 869840

SEQ ID NO: 869844 - protein, 289 aa, Homo sapiens; identical to SEQ ID NO: 869840

SEQ ID NO: 869845 - protein, 289 aa, Homo sapiens; identical to SEQ ID NO: 869840

SEQ ID NO: 869846 - protein, 289 aa, Homo sapiens; identical to SEQ ID NO: 869840

SEQ ID NO: 869847 - protein, 222 aa, Homo sapiens
MRWGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 869848 - protein, 222 aa, Homo sapiens; identical to SEQ ID NO: 869847

SEQ ID NO: 869849 - protein, 222 aa, Homo sapiens; identical to SEQ ID NO: 869847

SEQ ID NO: 869850 - protein, 273 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKHTLIVADTENLLKAPTIVGKSSLNPILFRGVGMVADPDNPLVLDILTGSSTSYSFFPDKPITQYPHAVGEEHPPHCWAPGQEQCPRHLQRLPRLLQRLLLQLSSAEGGARLPEVFPDRQL

SEQ ID NO: 869851 - protein, 222 aa, Homo sapiens; identical to SEQ ID NO: 869847

SEQ ID NO: 869852 - protein, 287 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGEEHPPHCWAPGQEQCPRHLQRLPRLLQRMLGLFIFSIVFLHMKEKEKSD

SEQ ID NO: 869853 - protein, 287 aa, Homo sapiens; identical to SEQ ID NO: 869852

SEQ ID NO: 869854 - protein, 108 aa, Homo sapiens
ETRLVRARCESAEASTAARAWALFWLLLPLLGAVCASGPRTLVLLDNLNVRETHSLFFRSLKDRGFELTFKTADDPSLSLIKYGEFLYDNLIIFSPSVEGIPRQATMN

SEQ ID NO: 869855 - protein, 281 aa, Homo sapiens
ETTLVRARCESAEASTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGEEHPPHCWAPGQEQCPRHLQRLPRLLQRMLGLFIFSIVFLHMKEKEKSD

SEQ ID NO: 869856 - protein, 163 aa, Homo sapiens
LLGIPAMFVGWELSAALPAGGGRPPVMASPGYPGLLSQEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 869857 - protein, 258 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGEEHPPHCWAPGQEQCPRHLQRLPRLLQRLLLQLSSAEGGARLPESCQEA

SEQ ID NO: 869858 - protein, 289 aa, Homo sapiens; identical to SEQ ID NO: 869840

SEQ ID NO: 869859 - protein, 289 aa, Homo sapiens; identical to SEQ ID NO: 869840

SEQ ID NO: 869860 - protein, 289 aa, Homo sapiens; identical to SEQ ID NO: 869840

SEQ ID NO: 869861 - protein, 289 aa, Homo sapiens; identical to SEQ ID NO: 869840

SEQ ID NO: 869862 - protein, 289 aa, Homo sapiens; identical to SEQ ID NO: 869840

SEQ ID NO: 869863 - protein, 289 aa, Homo sapiens; identical to SEQ ID NO: 869840

SEQ ID NO: 869864 - protein, 289 aa, Homo sapiens; identical to SEQ ID NO: 869840

SEQ ID NO: 869865 - protein, 289 aa, Homo sapiens; identical to SEQ ID NO: 869840

SEQ ID NO: 869866 - protein, 309 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGEEHPPHCWAPGQEQCPRHLQRLPRLLQRLLLQLSSAEGGARLPERGKMAQLYLCGRCNTESQGVGVGIIFI

SEQ ID NO: 869867 - protein, 222 aa, Homo sapiens; identical to SEQ ID NO: 869847

SEQ ID NO: 869868 - protein, 278 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGEEHPPSPAGCSRRRVSSVWGLCPIIGWARQPHPMPTLSLT

SEQ ID NO: 869869 - protein, 222 aa, Homo sapiens; identical to SEQ ID NO: 869847

SEQ ID NO: 869870 - protein, 203 aa, Homo sapiens
MVDMSGPAHQAPLERWLWCPSCSCFPPAGYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 869871 - protein, 278 aa, Homo sapiens; identical to SEQ ID NO: 869868

SEQ ID NO: 869872 - protein, 201 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVG

SEQ ID NO: 869873 - protein, 646 aa, Homo sapiens
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKTVHYNPTSTKHFSFSVGAVPRALQPQLGILRYFASYMEQHLMKGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 869874 - protein, 684 aa, Homo sapiens
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKVCGSPDLKSICVFPGIERGQVTGPLEPLFSVHMVPLPEGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKTVHYNPTSTKHFSFSVGAVPRALQPQLGILRYFASYMEQHLMKGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 869875 - protein, 511 aa, Homo sapiens
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKVEICPVWKR

SEQ ID NO: 869876 - protein, 776 aa, Homo sapiens
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEVRRSGGHCSPDSPPPQQLREAGDEKRLLKHPASWWPNWLCVTSLAGLTWGALGARAGPGHGLKGLDFGACVTPFPCPTLQAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKYSAVMGCLVFRPLIQQGRTLVSAPGLRGLGFSEEGHWCRAPSGPLPPHSRTVHYNPTSTKHFSFSVGAVPRALQPQLGILRYFASYMEQHLMKGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 869877 - protein, 102 aa, Homo sapiens
MGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 869878 - protein, 646 aa, Homo sapiens; identical to SEQ ID NO: 869873

SEQ ID NO: 869879 - protein, 621 aa, Homo sapiens
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKTVHYNPTSTKHFSFSVGAVPRALQPQLGILRYFASYMEQHLMKGGDLPSVEEVEVPAPRAFQELREGLGGPGCWGGSWARSLGPDHCHALCAGELLRGPHQADSQWLGAPPCDFCGPKS

SEQ ID NO: 869880 - protein, 696 aa, Homo sapiens
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKYSAVMGCLVFRPLIQQGRTLVSAPGLRGLGFSEEGHWCRAPSGPLPPHSRTVHYNPTSTKHFSFSVGAVPRALQPQLGILRYFASYMEQHLMKGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 869881 - protein, 502 aa, Homo sapiens [sequence omitted]

SEQ ID NO: 869882 - protein, 101 aa, Homo sapiens
RQTGEMEERQGEGQTGEMGRDRRGGREMERQERWGETGEMEERQGEGQTDGETWRGGGERDKGRNGRREVLIGSGSVSPPKPHLVAPIIPTCCGRELVEDG

SEQ ID NO: 869883 - protein, 119 aa, Homo sapiens
FNVTEDYRRLKSLLTDFFRGPTVSNICLAGLEYVLHFTALNGKIYFRRYKLLLKKSGCRTPRIELEEIGPSLNLVLRRTHLASDDLYTLSMKMPKALKPKKKKNISNDTFGTTYGRIHM

SEQ ID NO: 869884 - protein, 113 aa, Homo sapiens
DRPTLASQSARITGVSHSAWPPFLYSNLNVVILILHGFLILPQQTAKRLLESHMTFAVICTADGKTLLGSEGQGCHWIPLPSDPSENLTWTKTRVVKSHRESVIPNLLLSCAS

SEQ ID NO: 869885 - protein, 70 aa, Homo sapiens
EEQQSILLAQLESQDGDILRQRDEFDLLVAGEICRFSALIEELEEKNERPARELLTVRPEPEPCPTCAVL

SEQ ID NO: 869886 - protein, 395 aa, Homo sapiens
MASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGEKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLEKLCFELDYEPAHISLDPQTSHPKLLLSEDHQRAQFSYKWQNSPDNPQRFDRATCVLAHTGITGGRHTWVWMARVPGDSGCCQFCSPPSVLGTEVAA

SEQ ID NO: 869887 - protein, 189 aa, Homo sapiens
MTHRTTTWARRTSRAVTPTCATPAGPMPCSRLPPSLRCSLHSACCSGDPASYRLWGAPLQPTLGVVPQASVPLLTDLAQWEPVLVPEAHPNASLTMYVCTPVPHPDPPMALSRTPTRQISSSDTDPPADGPSNPLCCCFHGPAFSTLNPVLRHLFPQEAFPAHPIYDLSQVWSVVSPAPSRGQALRRAQ

SEQ ID NO: 869888 - protein, 70 aa, Homo sapiens
PHPALKALGLLQFWGSHRRPGFRADQPRTVFPVQFLMRGGQCCLPVTRTSAQPACLTPLLSWGPIHTQFR

SEQ ID NO: 869889 - protein, 129 aa, Homo sapiens
HSPPVTMKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 869890 - protein, 189 aa, Homo sapiens; identical to SEQ ID NO: 869887

SEQ ID NO: 869891 - protein, 129 aa, Homo sapiens; identical to SEQ ID NO: 869889

SEQ ID NO: 869892 - protein, 49 aa, Homo sapiens
MGQPLRPLPLHPTGTALLCYSCKAQVSNEDCLQVENCTQLGEQCWTARI

SEQ ID NO: 869893 - protein, 164 aa, Homo sapiens [sequence omitted]

SEQ ID NO: 869894 - protein, 181 aa, Homo sapiens [sequence omitted]

SEQ ID NO: 869895 - protein, 121 aa, Homo sapiens
MGGGVEIAAASFPRIYLMGMCSRQDRIQKDIDVVIQKSRAEDCLFAGSDCTFSTSFSMAVSLTTCFGPRAEMSILETNQYFRSELEKCKQNFQDLTEKFLTSKATAYSLANHLQKYRYMIP

SEQ ID NO: 869896 - protein, 200 aa, Homo sapiens
MEILEPEGETPETPRSATQPETPGVPREAERPVGSRDGSSGSLCRLHPVKEPVSTLPSRCWAAAELPLPSSDPVFRPGLHQGRDGGEGRSWVPWQGAGSGTHKGARLRTCRMNPLSPLAFSPLKRGSDCTFSTSFSMAVSLTTCFGPRAEMSILETNQYFRSELEKCKQNFQDLTEKFLTSKATAYSLANHLQKYRYMIP

SEQ ID NO: 869897 - protein, 363 aa, Homo sapiens
MRQELKNLKLAVDRERERPVKAGKKKDKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMNEPKRLKKHLPQILKLLKPDDRILIVGTTRRPFDAELQSFCKVYQKIILVPRPDYASRYVLWKQIIERNGGVLTSALNVSCLAKVTDGFTQGHIVEVVKGVLTDQRIRRQIHKPLTAVEFITAITSMNPVYKEEEESFKNWYAKTPLGKNVPWR

SEQ ID NO: 869898 - protein, 363 aa, Homo sapiens; identical to SEQ ID NO: 869897

SEQ ID NO: 869899 - protein, 464 aa, Homo sapiens
MSNAMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVQLRLWCSNSKSFTSTIVLLYKFPY

SEQ ID NO: 869900 - protein, 476 aa, Homo sapiens
MSNAMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKGKRK

SEQ ID NO: 869901 - protein, 476 aa, Homo sapiens; identical to SEQ ID NO: 869900

SEQ ID NO: 869902 - protein, 124 aa, Homo sapiens [sequence omitted]

SEQ ID NO: 869903 - protein, 124 aa, Homo sapiens [sequence omitted]

SEQ ID NO: 869904 - protein, 124 aa, Homo sapiens [sequence omitted]

SEQ ID NO: 869905 - protein, 732 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAAVAILAASNGYGSSSSTNSSATSSSAYRQPVKK

SEQ ID NO: 869906 - protein, 732 aa, Homo sapiens; identical to SEQ ID NO: 869905

SEQ ID NO: 869907 - protein, 533 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQSES

SEQ ID NO: 869908 - protein, 533 aa, Homo sapiens; identical to SEQ ID NO: 869907

SEQ ID NO: 869909 - protein, 533 aa, Homo sapiens; identical to SEQ ID NO: 869907

SEQ ID NO: 869910 - protein, 533 aa, Homo sapiens; identical to SEQ ID NO: 869907

SEQ ID NO: 869911 - protein, 460 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDVCFINVTSLCPVVSQVI

SEQ ID NO: 869912 - protein, 419 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAESKLKPCQFSLRYWGRV

SEQ ID NO: 869913 - protein, 533 aa, Homo sapiens; identical to SEQ ID NO: 869907

SEQ ID NO: 869914 - protein, 642 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQATAALPVYTTTTSAAHNL

SEQ ID NO: 869915 - protein, 521 aa, Homo sapiens
MYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQSES

SEQ ID NO: 869916 - protein, 251 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRKLKPCQFSLRYWGRV

SEQ ID NO: 869917 - protein, 533 aa, Homo sapiens; identical to SEQ ID NO: 869907

SEQ ID NO: 869918 - protein, 779 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAVLSQLGSAENRPEQSLPQQRFQLSSAFQQQQQQIQQLRFLQHQMAMAAAAAQTAQLHHHRHTGSQSKSKMKRGTPTTPKF

SEQ ID NO: 869919 - protein, 216 aa, Homo sapiens [sequence omitted]

SEQ ID NO: 869920 - protein, 141 aa, Homo sapiens
MLSPAALSPASSSQRTTATQVMANSAGLNFINVVGSVCGAQALMSGSNPMLGCNTGAITPAGINLSGLLPSGGLLPNALPSAMQAASQAGNSSSPSLHHNNLSSPQLVVLNSQGSRVLSKVQPVKNRPYLLSKLLLLTLLE

SEQ ID NO: 869921 - protein, 497 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSDYFTPRQTNSFLMKRPKDNL

SEQ ID NO: 869922 - protein, 114 aa, Homo sapiens
YLYILKYKLFSCVINFQFCYNHEFYLTGVPFGLKNTSSLRPLNLLQGSEQGSTSQEQALSAQQAAVINLTGVGSFMQSQAAAVAILAASNGYGSSSSTNSSATSSSAYRQPVKK

SEQ ID NO: 869923 - protein, 181 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQNFKFVDGPFQ

SEQ ID NO: 869924 - protein, 533 aa, Homo sapiens; identical to SEQ ID NO: 869907

SEQ ID NO: 869925 - protein, 533 aa, Homo sapiens; identical to SEQ ID NO: 869907

SEQ ID NO: 869926 - protein, 533 aa, Homo sapiens; identical to SEQ ID NO: 869907

SEQ ID NO: 869927 - protein, 534 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRHES

SEQ ID NO: 869928 - protein, 533 aa, Homo sapiens; identical to SEQ ID NO: 869907

SEQ ID NO: 869929 - protein, 533 aa, Homo sapiens; identical to SEQ ID NO: 869907

SEQ ID NO: 869930 - protein, 811 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRSGTPKPSTPTPTPSSTPHPPDAQSSTPSTPSATPTPQDSGFTPQPTLLTQFAQQQRSLSQAMPVTTIPLSTMVTSITPGTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAAVAILAASNGYGSSSSTNSSATSSSAYRQPVKK

SEQ ID NO: 869931 - protein, 521 aa, Homo sapiens; identical to SEQ ID NO: 869915

SEQ ID NO: 869932 - protein, 642 aa, Homo sapiens; identical to SEQ ID NO: 869914

SEQ ID NO: 869933 - protein, 533 aa, Homo sapiens; identical to SEQ ID NO: 869907

SEQ ID NO: 869934 - protein, 169 aa, Homo sapiens
GIEWPCEADEEGDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQSES

SEQ ID NO: 869935 - protein, 695 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGPFVLNNTSSPGLKFYSGSGGSTYFNTLRRRNSSLPRYTQRNLGAKFGCSHARRRFGHVTVRKAHCHTVFNPGERFAPSGGLSTVWGTPI

SEQ ID NO: 869936 - protein, 489 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSAQVPPVAMFTGL

SEQ ID NO: 869937 - protein, 460 aa, Homo sapiens; identical to SEQ ID NO: 869911

SEQ ID NO: 869938 - protein, 188 aa, Homo sapiens
MTQTPAPSGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEEEEESKPPIPTQVGPATASPDLGTSMATGTPDSTAPITIWRSESPTGKGQGSKVIKKVKK

SEQ ID NO: 869939 - protein, 236 aa, Homo sapiens
GAHPQCLEVEESSSAPQDGEDSVQMSITYVNRLPSWERGHLLAGVASSTDVSTFSEGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEEEEESKPPIPTQVGPATASPDLGTSMATGTPDSTAPITIWRSESPTGKGQGSKVIKKVKK

SEQ ID NO: 869940 - protein, 188 aa, Homo sapiens; identical to SEQ ID NO: 869938

SEQ ID NO: 869941 - protein, 210 aa, Homo sapiens
MWVRTTLTIERWTKEKTEPKARSWDESRCRGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEEEEESKPPIPTQVGPATASPDLGTSMATGTPDSTAPITIWRSESPTGKGQGSKVIKKVKK

SEQ ID NO: 869942 - protein, 34 aa, Homo sapiens
MATGTPDSTAPITIWRSESPTGKGQGSKVIKKVK

SEQ ID NO: 869943 - protein, 591 aa, Homo sapiens
MGKKGKVGKSRRDKFYHLAKETGYRSRSAFKLIQLNRRFQFLQKARALLDLCAAPGGWLQVAAKFMPVSSLIVGVDLVPIKPLPNVVTLQEDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVTDFLRAANPVDFLSKASEIMVDDEELAQHPATTEDIRVCCQDIRVLGRKELRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLCTIRGHQLLEEVTQGDMSAADTFLSDLPRDDIYVLIIFLICFLVLYALFLTLTTKLTNTNISDAQEIETVCTILPAIILVLIALPSLRILYITDEVNDPSLTIKSIGHQWYCTYEYTDYGGLIFNSYILPPLFLEPGDLRLLDVDNRVVLPIEAPIRIIITSQDVLHS

SEQ ID NO: 869944 - protein, 847 aa, Homo sapiens
MGKKGKVGKSRRDKFYHLAKETGYRSRSAFKLIQLNRRFQFLQKARALLDLCAAPGGWLQVAAKFMPVSSLIVGVDLVPIKPLPNVVTLQEDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVTDFLRAANPVDFLSKASEIMVDDEELAQHPATTEDIRVCCQDIRVLGRKELRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLCTIRGHQLLEEVTQGDMSAADTFLSDLPRDDIYVSDVEDDGDDTSLDSDLDPEELAGVRGHQGLRDQKRMRLTEVQDDKEEEEEENPLLVPLEEKAVLQEEQANLWFSKGSFAGIEDDADEALEISQAQLLFENRRKGRQQQQKQQLPQTPPSCLKTEIMSPLYQDEAPKGTEASSGTEAATGLEGEEKDGISDSDSSTSSEEEESWEPLRGKKRSRGPKSDDDGFEIVPIEDPAKHRILDPEGLALGAVIASSKKAKRDLIDNSFNRYTFNEDEGELPEWFVQEEKQHRIRQLPVGKKEVEHYRKRWREINARPIKKVAEAKARKKRRMLKRLEQTRKKAEAVVNTVDISEREKVAQLRSLYKKAGLGKEKRHVTYVVAKKGVGRKVRRPAGVRGHFKVVDSRMKKDQRAQQRKEQKKKHKRK

SEQ ID NO: 869945 - protein, 782 aa, Homo sapiens [sequence omitted]

SEQ ID NO: 869946 - protein, 847 aa, Homo sapiens; identical to SEQ ID NO: 869944

SEQ ID NO: 869947 - protein, 485 aa, Homo sapiens
MKVMRRTQQLEPQSSPLRRRRKRKKKKLLREQRKQRERVELKMDLPGVSIADEGETGMFSLCTIRGHQLLEEVTQGDMSAADTFLSDLPRDDIYVSDVEDDGDDTSLDSDLDPEELAGVRGHQGLRDQKRMRLTEVQDDKEEEEEENPLLVPLEEKAVLQEEQANLWFSKGSFAGIEDDADEALEISQAQLLFENRRKGRQQQQKQQLPQTPPSCLKTEIMSPLYQDEAPKGTEASSGTEAATGLEGEEKDGISDSDSSTSSEEEESWEPLRGKKRSRGPKSDDDGFEIVPIEDPAKHRILDPEGLALGAVIASSKKAKRDLIDNSFNRYTFNEDEGELPEWFVQEEKQHRIRQLPVGKKEVEHYRKRWREINARPIKKVAEAKARKKRRMLKRLEQTRKKAEAVVNTVDISEREKVAQLRSLYKKAGLGKEKRHVTYVVAKKGVGRKVRRPAGVRGHFKVVDSRMKKDQRAQQRKEQKKKHKRK

SEQ ID NO: 869948 - protein, 754 aa, Homo sapiens
MGKKGKVGKSRRDKFYHLAKETGYRSRSAFKLIQLNRRFQFLQKARALLDLCAAPGGWLQVAAKFMPVSSLIVGVDLVPIKPLPNVVTLQEDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVTDFLRAANPVDFLSKASEIMVDDEELAQHPATTEDIRVCCQDIRVLGRKELRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLCTIRGHQLLEEVTQGDMSAADTFLSDLPRDDIYVSDVEDDGDDTSLDSDLDPEELAGVRGHQGLRDQKRMRLTEVQDDKEEEEEENPLLVPLEEKAVLQEEQANLWFSKGSFAGIEDDADEALEISQAQLLFENRRKGRQQQQKQQLPQTPPSCLKTEIMSPLYQDEAPKGTEASSGTEAATGLEGEEKDGISDSDSSTSSEEEESWEPLRGKKRSRGPKSDDDGFEIVPIEDPAKHRILDPEGLALGAVIASSKKAKRDLIDNSFNRYTFNEDEGELPEWFVQEEKQHRIRQLPVGKKEVEHYRKRWREINARPIKKVAEAKARKKRRML

SEQ ID NO: 869949 - protein, 434 aa, Homo sapiens
MGKKGKVGKSRRDKFYHLAKETGYRSRSAFKLIQLNRRFQFLQKARALLDLCAAPGGWLQVAAKFMPVSSLIVGVDLVPIKPLPNVVTLQEDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVTDFLRAANPVDFLSKASEIMVDDEELAQHPATTEDIRVCCQDIRVLGRKELRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLCTIRGHQYATY

SEQ ID NO: 869950 - protein, 516 aa, Homo sapiens
MGKKGKVGKSRRDKFYHLAKETGYRSRSAFKLIQLNRRFQFLQKARALLDLCAAPGGWLQVAAKFMPVSSLIVGVDLVPIKPLPNVVTLQEDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVTDFLRAANPVDFLSKASEIMVDDEELAQHPATTEDIRVCCQDIRVLGRKELRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLCTIRGHQLLEEVTQGDMSAADTFLSDLPRDDIYVSDVEDDGDDTSLDSDLDPEELAGVRGHQGLRDQKRMRLTEVQDDKEEEEVECLELPWWS

SEQ ID NO: 869951 - protein, 847 aa, Homo sapiens; identical to SEQ ID NO: 869944

SEQ ID NO: 869952 - protein, 847 aa, Homo sapiens; identical to SEQ ID NO: 869944

SEQ ID NO: 869953 - protein, 829 aa, Homo sapiens
MGKKGKVGKSRRDKFYHLAKETGYRSRSAFKLIQLNRRFQFLQKARALLDLCAAPGGWLQVAAKFMPVSSLIVGVDLVPIKPLPNVVTLQEDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVTDFLRAANPVDFLSKASEIMVDDEELAQHPATTEDIRVCCQDIRVLGRKELRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLCTIRGHQLLEEVTQGDMSAADTFLSDLPRDDIYVSDVEDDGDDTSLDSDLDPEELAGVRGHQGLRDQKRMRLTEVQDDKEEEEEENPLLVPLEEKAVLQEEQANLWFSKGSFAGIEDDADEALEISQAQLLFENRRKGRQQQQKQQLPQTPPSCLKTEIMSPLYQDEAPKGTEASSGTEAATGLEGEDWEPLRGKKRSRGPKSDDDGFEIVPIEDPAKHRILDPEGLALGAVIASSKKAKRDLIDNSFNRYTFNEDEGELPEWFVQEEKQHRIRQLPVGKKEVEHYRKRWREINARPIKKVAEAKARKKRRMLKRLEQTRKKAEAVVNTVDISEREKVAQLRSLYKKAGLGKEKRHVTYVVAKKGVGRKVRRPAGVRGHFKVVDSRMKKDQRAQQRKEQKKKHKRK

SEQ ID NO: 869954 - protein, 873 aa, Homo sapiens
MGKKGKVGKSRRDKFYHLAKETGYRSRSAFKLIQLNRRFQFLQKARALLDLCAAPGGWLQVAAKFMPVSSLIVGVDLVPIKPLPNVVTLQEDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVTDFLRAANPVDFLSKASEIMVDDEELAQHPATTEDIRVCCQDIRVLGRKELRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLCTIRGHQLLEEVTQGDMSAADTFLSDLPRDDIYVSDVEDDGDDTSLDSDLDPEELAGVRGHQGLRDQKRMRLTEVQDDKEEEEEENPLLVPLEEKAVLQEEQANLWFSKVRRGRGQDCGEMSLPWEKGSYVLLSQGSFAGIEDDADEALEISQAQLLFENRRKGRQQQQKQQLPQTPPSCLKTEIMSPLYQDEAPKGTEASSGTEAATGLEGEEKDGISDSDSSTSSEEEESWEPLRGKKRSRGPKSDDDGFEIVPIEDPAKHRILDPEGLALGAVIASSKKAKRDLIDNSFNRYTFNEDEGELPEWFVQEEKQHRIRQLPVGKKEVEHYRKRWREINARPIKKVAEAKARKKRRMLKRLEQTRKKAEAVVNTVDISEREKVAQLRSLYKKAGLGKEKRHVTYVVAKKGVGRKVRRPAGVRGHFKVVDSRMKKDQRAQQRKEQKKKHKRK

SEQ ID NO: 869955 - protein, 603 aa, Homo sapiens
QGKAMMLDLWEEDIAVLKVWDGGLSLLIYVAEARKVGSEPKTEGGGDKEGDGKISNQYLWGRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLCTIRGHQLLEEVTQGDMSAADTFLSDLPRDDIYVSDVEDDGDDTSLDSDLDPEELAGVRGHQGLRDQKRMRLTEVQDDKEEEEEENPLLVPLEEKAVLQEEQANLWFSKGSFAGIEDDADEALEISQAQLLFENRRKGRQQQQKQQLPQTPPSCLKTEIMSPLYQDEAPKGTEASSGTEAATGLEGEEKDGISDSDSSTSSEEEESWEPLRGKKRSRGPKSDDDGFEIVPIEDPAKHRILDPEGLALGAVIASSKKAKRDLIDNSFNRYTFNEDEGELPEWFVQEEKQHRIRQLPVGKKEVEHYRKRWREINARPIKKVAEAKARKKRRMLKRLEQTRKKAEAVVNTVDISEREKVAQLRSLYKKAGLGKEKRHVTYVVAKKGVGRKVRRPAGVRGHFKVVDSRMKKDQRAQQRKEQKKKHKRK

SEQ ID NO: 869956 - protein, 119 aa, Homo sapiens
SYCSYHRFQNGNSLPSQRRSLQRAMLKRLEQTRKKAEAVVNTVDISEREKVAQLRSLYKKAGLGKEKRHVTYVVAKKGVGRKVRRPAGVRGHFKVVDSRMKKDQRAQQRKEQKKKHKRK

SEQ ID NO: 869957 - protein, 105 aa, Homo sapiens
MSIRLHQNLGRGRTKSCLKKLVAGANCRDQDDPSQRNQQPRSATFRSTTEARQGEQSCWPQSFLLFRAGEAEAHSLDMFLMVLCSFMAFSQSLPLNSSVTILRTG

SEQ ID NO: 869958 - protein, 257 aa, Homo sapiens
CCLPIMEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGCSVLTLQSVNVLRKYISLLDLPLSLLHTQDVLFVLNSKEVAQAKKAMSCHRSQLLWFRRLYIIFSRYMRINSLSFL

SEQ ID NO: 869959 - protein, 257 aa, Homo sapiens; identical to SEQ ID NO: 869958

SEQ ID NO: 869960 - protein, 257 aa, Homo sapiens; identical to SEQ ID NO: 869958

SEQ ID NO: 869961 - protein, 143 aa, Homo sapiens
CCLPIMEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRLECNGAISAHCNLRFPGSSDSPASAS

SEQ ID NO: 869962 - protein, 103 aa, Homo sapiens
CCLPIMEAMWLLCVALAVLAWGFLWVWDSSERMKSREQGGRLGAESRTLLVIAHPDDEAMFFAPTVLGLARLRHWVYLLCFSAVFRRELSEYTEGLTSEPLTA

SEQ ID NO: 869963 - protein, 87 aa, Homo sapiens
CCLPIMEAMWLLCVALAVLAWGFLWVWDSSERMKSREQGGRLGAESRTLLVIAHPDDEAMFFAPTVLGLARLRHWVYLLCFSAGRRP

SEQ ID NO: 869964 - protein, 249 aa, Homo sapiens
CCLPIMEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRVLCAHASVCECAAQVHLPSGSALVSASYAGCPLRAQQQRSGTGQESHVLPPQPAPLVPPPLHYLLPVHENQLTELPLKP

SEQ ID NO: 869965 - protein, 117 aa, Homo sapiens
CCLPIMEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNR

SEQ ID NO: 869966 - protein, 257 aa, Homo sapiens; identical to SEQ ID NO: 869958

SEQ ID NO: 869967 - protein, 257 aa, Homo sapiens; identical to SEQ ID NO: 869958

SEQ ID NO: 869968 - protein, 199 aa, Homo sapiens
CCLPIMEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGKACSFCKGPQDTVPLRNL

SEQ ID NO: 869969 - protein, 199 aa, Homo sapiens; identical to SEQ ID NO: 869968

SEQ ID NO: 869970 - protein, 199 aa, Homo sapiens; identical to SEQ ID NO: 869968

SEQ ID NO: 869971 - protein, 150 aa, Homo sapiens
CCLPIMEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRLSYLRLMCLSEAQGPQQHTPVSQSSDYSSLGMG

SEQ ID NO: 869972 - protein, 588 aa, Homo sapiens
MARGGAGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 869973 - protein, 284 aa, Homo sapiens
MVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 869974 - protein, 139 aa, Homo sapiens
MRQTSSLPLGNQAPSCTSGHPLMTSGSSQPRAGPSGVLLSTWDKDTGWRTRRTRKRLKVGGWPAFANSWRVGFWGQVGDPHGVLASSGRRSPPSSMRHLCLLRLPHQGTLLVGPGHWASHPADSPLGPLRAEPLDFLWD

SEQ ID NO: 869975 - protein, 228 aa, Homo sapiens
PRVAHASVMGLVCVAITFYQTLWARPRRARQARRVGGGGGTKAGGPGALGTRPAFEVPAIVVEDARGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQSLSGVCP

SEQ ID NO: 869976 - protein, 588 aa, Homo sapiens; identical to SEQ ID NO: 869972

SEQ ID NO: 869977 - protein, 426 aa, Homo sapiens
MARGGAGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQLKKLDLAAAAAHTFFVANPMHLQMREDMAKYRRMSGVR

SEQ ID NO: 869978 - protein, 588 aa, Homo sapiens; identical to SEQ ID NO: 869972

SEQ ID NO: 869979 - protein, 527 aa, Homo sapiens
MAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 869980 - protein, 304 aa, Homo sapiens
MLSTGVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 869981 - protein, 134 aa, Homo sapiens
MVLAVLWCSMAQTLLLPSFIWSCERYRADVRTVWEQCVAIMSEEDGDDGQRRGWALAFLDICLFPFLPLLLSQRMGCPWSAPYWTESAPPWAPLSLSRHPAVHSLLPAALRAPFTGPRLPSRNPHCPALALWGT

SEQ ID NO: 869982 - protein, 571 aa, Homo sapiens
MARGGAGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 869983 - protein, 588 aa, Homo sapiens; identical to SEQ ID NO: 869972

SEQ ID NO: 869984 - protein, 399 aa, Homo sapiens [sequence omitted]

SEQ ID NO: 869985 - protein, 284 aa, Homo sapiens; identical to SEQ ID NO: 869973

SEQ ID NO: 869986 - protein, 275 aa, Homo sapiens
MPYANQPTVRITELTDENVKFIIENTDLAVANSIRRVFIAEVPIIAIDWVQIDANSSVLHDEFIAHRLGLIPLISDDIVDKLQYSRDCTCEEFCPECSVEFTLDVRCNEDQTRHVTSRDLISNSPRVIPVTSRNRDNDPNDYVEQDDILIVKLRKGQELRLRAYAKKGFGKEHAKWNPTAGVAFEYDPDNALRHTVYPKPEEWPKSEYSELDEDESQAPYDPNGKPERFYYNVESCGSLRPETIVLSALSGLKKKLSDLQTQLSHEIQSDVLTIN

SEQ ID NO: 869987 - protein, 275 aa, Homo sapiens; identical to SEQ ID NO: 869986

SEQ ID NO: 869988 - protein, 275 aa, Homo sapiens; identical to SEQ ID NO: 869986

SEQ ID NO: 869989 - protein, 275 aa, Homo sapiens; identical to SEQ ID NO: 869986

SEQ ID NO: 869990 - protein, 287 aa, Homo sapiens
MRPGGDAEQTRRLVAPGRDAVRITELTDENVKFIIENTDLAVANSIRRVFIAEVPIIAIDWVQIDANSSVLHDEFIAHRLGLIPLISDDIVDKLQYSRDCTCEEFCPECSVEFTLDVRCNEDQTRHVTSRDLISNSPRVIPVTSRNRDNDPNDYVEQDDILIVKLRKGQELRLRAYAKKGFGKEHAKWNPTAGVAFEYDPDNALRHTVYPKPEEWPKSEYSELDEDESQAPYDPNGKPERFYYNVESCGSLRPETIVLSALSGLKKKLSDLQTQLSHEIQSDVLTIN

SEQ ID NO: 869991 - protein, 219 aa, Homo sapiens [sequence omitted]

SEQ ID NO: 869992 - protein, 275 aa, Homo sapiens; identical to SEQ ID NO: 869986

SEQ ID NO: 869993 - protein, 275 aa, Homo sapiens; identical to SEQ ID NO: 869986

SEQ ID NO: 869994 - protein, 275 aa, Homo sapiens; identical to SEQ ID NO: 869986

SEQ ID NO: 869995 - protein, 275 aa, Homo sapiens; identical to SEQ ID NO: 869986

SEQ ID NO: 869996 - protein, 275 aa, Homo sapiens; identical to SEQ ID NO: 869986

SEQ ID NO: 869997 - protein, 326 aa, Homo sapiens
PLSFSLRGARVRVLTLSSWRACAPPALWAVPAPLLSFPSVLASAVSRPPLVGSLVLLLVRLGRSALSRSAPGPLPPLPSRRCSSRPPPPSPLPLRSSALVAVPASSCRLAASPRVSLGFPCVSPRSVSWPVRLLRSSLSLLLLSSPLASAAAAFPGSLLPPSLGPFAAASAGSRSRRLGRSRGDTPPSRLCRPGGGASLRLRARCAAGRRSPGGRPGRPVFAPPSRRARCLSLARAPPPRGMSCWRLRPRERPTASLSGRGPRRSGFVLVASDSPPVLTFLSAGSSRRSKGPSHIHRRSISFLLNEGSGPNPSALSPDRNMHKAVN

SEQ ID NO: 869998 - protein, 105 aa, Homo sapiens
FSDGVSLCHPDWSAFSPHRVGAAGRHPAPVSLHSKAVTSVASSCLCDDPHEGCRVKGTAGFGLTPRGALGERAWSWGAAQVFYIPWPPSSPARLSSWPCAPGDAC

SEQ ID NO: 869999 - protein, 286 aa, Homo sapiens
LVQPHNVPSIVHSQVYRSSKVEKLPPLYKTLTFSGSSQTITPENQTLNYSSNQQEVLSSVTNENYPAQTRDLSSVSQSQSYSSGHSQGLSPVSQTQVSYSSQSQVLSVVSLSESYASGESLTLTAPSLSYSSASRAQNLPDSSPTQNYISMHSSQNVQTQESSSPQSQKFLPAVQSSSFASSTHCQTLQNNITSPDPKSYAERKLDSDVYPSSKQEDGFPMQELQVLQPQASLESSTQRLSDGEINAQESTYKVSKADDRYSQSVIRSNSRLEDQVIGVALQASKK

SEQ ID NO: 870000 - protein, 809 aa, Homo sapiens
ARRQTSCSRRPESADTMWIQVRTMDGRQTHTVDSLSRLTKVEELRRKIQELFHVEPGLQRLFYRGKQMEDGHTLFDYEVRLNDTIQLLVRQSLVLPHSTKERDSELSDTDSGCCLGQSESDKSSTHGEAAAETDSRPADEDMWDETELGLYKVNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGEGSPMVDNPMRRKSGPSCKHCKDDVNRLCRVCACHLCGGRQDPDKQLMCDECDMAFHIYCLDPPLSSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGSPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 870001 - protein, 807 aa, Homo sapiens
GARAAGGWRSSADTMWIQVRTMDGRQTHTVDSLSRLTKVEELRRKIQELFHVEPGLQRLFYRGKQMEDGHTLFDYEVRLNDTIQLLVRQSLVLPHSTKERDSELSDTDSGCCLGQSESDKSSTHGEAAAETDSRPADEDMWDETELGLYKVNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGEGSPMVDNPMRRKSGPSCKHCKDDVNRLCRVCACHLCGGRQDPDKQLMCDECDMAFHIYCLDPPLSSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGSPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 870002 - protein, 821 aa, Homo sapiens
RLLRAWHGSEVLVKLMGVFAVPPLSADTMWIQVRTMDGRQTHTVDSLSRLTKVEELRRKIQELFHVEPGLQRLFYRGKQMEDGHTLFDYEVRLNDTIQLLVRQSLVLPHSTKERDSELSDTDSGCCLGQSESDKSSTHGEAAAETDSRPADEDMWDETELGLYKVNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGEGSPMVDNPMRRKSGPSCKHCKDDVNRLCRVCACHLCGGRQDPDKQLMCDECDMAFHIYCLDPPLSSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGSPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 870003 - protein, 110 aa, Homo sapiens
QGLPGQILAHVVLAHGRDGPEHQLLTAERVQGLPGQILSGTGVQLPCLPLRPGPQLCHAGEPASADRPQPALPRLRQWPVISKHFSTGVLLKTCRRARSSALILFLVGLT

SEQ ID NO: 870004 - protein, 72 aa, Homo sapiens
SMSYKERPGLLQTVSAQYDGHKVSDCLDRSFRAQVFSCPACRYDLGRSYAMQVNQPLQTVLNQLFPGYGNGR

SEQ ID NO: 870005 - protein, 124 aa, Homo sapiens
PLHTVGRGRPTSARFPLREGGLVLARGLRPGLSSQLPGERRGPDELQGRPSARPHHHQVAGPGGGPGGHAQLQPRQPQGAGLLVRRGDLQEARDQDGAGTLRQRGAGVSLASWGEPFLSPFLPS

SEQ ID NO: 870006 - protein, 821 aa, Homo sapiens; identical to SEQ ID NO: 870002

SEQ ID NO: 870007 - protein, 821 aa, Homo sapiens; identical to SEQ ID NO: 870002

SEQ ID NO: 870008 - protein, 821 aa, Homo sapiens; identical to SEQ ID NO: 870002

SEQ ID NO: 870009 - protein, 92 aa, Homo sapiens
PGGIVDQRRPTCAGLPGQILSGTGVQLPCLPLRPGPQLCHAGEPASADRPQPALPRLRQWPVISKHFSTGVLLKTCRRARSSALILFLVGLT

SEQ ID NO: 870010 - protein, 127 aa, Homo sapiens
ENPALALRRAAECRAYARGASRGLVSICPFCLRVKFAGENPTIRAEPLGGEPPPHPTPSPIPTDGKNDSIGQNRLPASINMDGLRSWCLGRMGASPGNRRRRRHEGRLPLLGLENVDSQRDQTNVVR

SEQ ID NO: 870011 - protein, 140 aa, Homo sapiens
MAQGLIEVERKFLPGPGTEERLQELGGTLEYRVTFRDTYYDTPELSLMQADHWLRRREDSGWELKCPGAAGVLGPHTEYKELTAEPTIVAQLCVPAQETAPAKLIVYLQRFRPQDYQRLLEVNSSRERPQETEDPDHCLG

SEQ ID NO: 870012 - protein, 230 aa, Homo sapiens
MAQGLIEVERKFLPGPGTEERLQELGGTLEYRVTFRDTYYDTPELSLMQADHWLRRREDSGWELKCPGAAGVLGPHTEYKELTAEPTIVAQLCKVLRADGLGAGDVAAVLGPLGLQEVASFVTKRSAWKLVLLGADEEEPQLRVDLDTADFGYAVGEVEALVHEEAEVPTALEKIHRLSSMLGVPAQETAPAKLIVYLQRFRPQDYQRLLEVNSSRERPQETEDPDHCLG

SEQ ID NO: 870013 - protein, 230 aa, Homo sapiens; identical to SEQ ID NO: 870012

SEQ ID NO: 870014 - protein, 99 aa, Homo sapiens
DWCSRGSPLEASVKVLRRSNRKKIDDPIDEEEEFEELKGSEPHMRTRNQGRRTAFYNEDDSEEEQRQLLFEDTSLTFGTSSRGRVRKLTEKAKANLIGW

SEQ ID NO: 870015 - protein, 535 aa, Homo sapiens
MHMAFVFHRQEEWRTAKGEEEIKTYRSEEKRKHLTVPKENKIPTVSKNHAHEHFLDLGESKKQQTNQHNYRTRSALEETPRPSEEIENGSSSSDEGEVVAVSGGTSEEEERAWHSDGSSSDYSSDYSDWTADAGINLQPPKKVPKNKTKKAESSSDEEEESEKQKQKQIKKEKKKVNEEKDGPISPKKKKPKERKQKRLAVGELTENGLTLEEWLPSTWITDTIPRRCPFVPQMGDEVYYFRQGHEAYVEMARKNKIYSINPKKQPWHKMELREQELMKIVGIKYEVGLPTLCCLKLAFLDPDTGKLTGGSFTMKYHDMPDVIDFLVLRQQFDDAKYRRWNIGDRFRSVIDDAWWFGTIESQEPLQLEYPDSLFQCYNVCWDNGDTEKMSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYRRVSSLMWEVRYIEHNTRTFNEPGSPIVKSAKFVTDLLLHFIK

SEQ ID NO: 870016 - protein, 845 aa, Homo sapiens
MARKNKIYSINPKKQPWHKMELREQELMKIVGIKYEVGLPTLCCLKLAFLDPDTGKLTGGSFTMKYHDMPDVIDFLVLRQQFDDAKYRRWNIGDRFRSVIDDAWWFGTIESQEPLQLEYPDSLFQCYNVCWDNGDTEKMSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYRRVSSLMWEVRYIEHNTRTFNEPGSPIVKSAKFVTDLLLHFIKDQTCYNIIPLYNSMKKKVLSDSEDEEKDADVPGTSTRKRKDHQPRRRLRNRAQSYDIQAWKKQCEELLNLIFQCEDSEPFRQPVDLLEYPDYRDIIDTPMDFATVRETLEAGNYESPMELCKDVRLIFSNSKAYTPSKRSRIYSMSLRLSAFFEEHISSVLSDYKSALRFHKRNTITKRRKKRNRSSSVSSSAASSPERKKRILKPQLKSESSTSAFSTPTRSIPPRHNAAQINGKTESSSVVRTRSNRVVVDPVVTEQPSTSSAAKTFITKANASAIPGKTILENSVKHSKALNTLSSPGQSSFSHGTRNNSAKENMEKEKPVKRKMKSSVLPKASTLSKSSAVIEQGDCKNNALVPGTIQVNGHGGQPSKLVKRGPGRKPKVEVNTNSGEIIHKKRGRKPKKLQYAKPEDLEQNNVHPIRDEVLPSSTCNFLSETNNVKEDLLQKKNRGGRKPKRKMKTQKLDADLLVPASVKVLRRSNRKKIDDPIDEEEEFEELKGSEPHMRTRNQGRRTAFYNEDDSEEEQRQLLFEDTSLTFGTSSRGRVRKLTEKAKANLIGW

SEQ ID NO: 870017 - protein, 1590 aa, Homo sapiens
LLATLRGHAAEISDMAVNYENTMIAAGSCDKMIRVWCLRTCAPLAVLQGHSASITSLQFSPLCSGSKRYLSSTGADGTICFWLWDAGTLKINPRPAKFTERPRPGVQMICSSFSAGGMFLATGSTDHIIRVYFFGSGQPEKISELEFHTDKVDSIQFSNTSNRFVSGSRDGTARIWQFKRREWKSILLDMATRPAGQNLQGIEDKITKMKVTMVAWDRHDNTVITAVNNMTLKVWNSYTGQLIHVLMGHEDEVFVLEPHPFDPRVLFSAGHDGNVIVWDLARGVKIRSYFNMIEGQGHGAVFDCKCSPDGQHFACTDSHGHLLIFGFGSSSKYDKIADQMFFHSDYRPLIRDANNLYVDEQTQQSTSSYASPFLVDVDGNPHPSRYQRLVPGRENCREEQLIPQMGVTSSGLNQVLSQQANQEISPLDSMIQRLQQEQDLRRSGEAGISNTSRLSRGSISSTSEVHSPPNVGLRRSGQIEGVRQMHSNAPRSEIATERDLVAWSRRVVVPELSAGVASRQEEWRTAKGEEEIKTYRSEEKRKHLTVPKENKIPTVSKNHAHEHFLDLGESKKQQTNQHNYRTRSALEETPRPSEEIENGSSSSDEGEVVAVSGGTSEEEERAWHSDGSSSDYSSDYSDWTADAGINLQPPKKVPKNKTKKAESSSDEEEESEKQKQKQIKKEKKKVNEEKDGPISPKKKKPKERKQKRLAVGELTENGLTLEEWLPSTWITDTIPRRCPFVPQMGDEVYYFRQGHEAYVEMARKNKIYSINPKKQPWHKMELREQELMKIVGIKYEVGLPTLCCLKLAFLDPDTGKLTGGSFTMKYHDMPDVIDFLVLRQQFDDAKYRRWNIGDRFRSVIDDAWWFGTIESQEPLQLEYPDSLFQCYNVCWDNGDTEKMSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYRRVSSLMWEVRYIEHNTRTFNEPGSPIVKSAKFVTDLLLHFIKDQTCYNIIPLYNSMKKKVLSDSEDEEKDADVPGTSTRKRKDIQAWKKQCEELLNLIFQCEDSEPFRQPVDLLEYPDYRDIIDTPMDFATVRETLEAGNYESPMELCKDVRLIFSNSKAYTPSKRSRIYSMSLRLSAFFEEHISSVLSDYKSALRFHKRNTITKRRKKRNRSSSVSSSAASSPERKKRILKPQLKSESSTSAFSTPTRSIPPRHNAAQINGKTESSSVVRTRSNRVVVDPVVTEQPSTSSAAKTFITKANASAIPGKTILENSVKHSKALNTLSSPGQSSFSHGTRNNSAKENMEKEKPVKRKMKSSVLPKASTLSKSSAVIEQGDCKNNALVPGTIQVNGHGGQPSKLVKRGPGRKPKVEVNTNSGEIIHKKRGRKPKKLQYAKPEDLEQNNVHPIRDEVLPSSTCNFLSETNNVKEDLLQKKNRGGRKPKRKMKTQKLDADLLVPASVKVLRRSNRKKIDDPIDEEEEFEELKGSEPHMRTRNQGRRTAFYNEDDSEEEQRQLLFEDTSLTFGTSSRGRVRKLTEKAKANLIGW

SEQ ID NO: 870018 - protein, 1045 aa, Homo sapiens
LLATLRGHAAEISDMAVNYENTMIAAGSCDKMIRVWCLRTCAPLAVLQGHSASITSLQFSPLCSGSKRYLSSTGADGTICFWLWDAGTLKINPRPAKFTERPRPGVQMICSSFSAGGMFLATGSTDHIIRVYFFGSGQPEKISELEFHTDKVDSIQFSNTSNRFVSGSRDGTARIWQFKRREWKSILLDMATRPAGQNLQGIEDKITKMKVTMVAWDRHDNTVITAVNNMTLKVWNSYTGQLIHVLMGHEDEVFVLEPHPFDPRVLFSAGHDGNVIVWDLARGVKIRSYFNMIEGQGHGAVFDCKCSPDGQHFACTDSHGHLLIFGFGSSSKYDKIADQMFFHSDYRPLIRDANNLYVDEQTQQSTSSYASPFLVDVDGNPHPSRYQRLVPGRENCREEQLIPQMGVTSSGLNQVLSQQANQEISPLDSMIQRLQQEQDLRRSGEAGISNTSRLSRGSISSTSEVHSPPNVGLRRSGQIEGVRQMHSNAPRSEIATERDLVAWSRRVVVPELSAGVASRQEEWRTAKGEEEIKTYRSEEKRKHLTVPKENKIPTVSKNHAHEHFLDLGESKKQQTNQHNYRTRSALEETPRPSEEIENGSSSSDEGEVVAVSGGTSEEEERAWHSDGSSSDYSSDYSDWTADAGINLQPPKKVPKNKTKKAESSSDEEEESEKQKQKQIKKEKKKVNEEKDGPISPKKKKPKERKQKRLAVGELTENGLTLEEWLPSTWITDTIPRRCPFVPQMGDEVYYFRQGHEAYVEMARKNKIYSINPKKQPWHKMELREQELMKIVGIKYEVGLPTLCCLKLAFLDPDTGKLTGGSFTMKYHDMPDVIDFLVLRQQFDDAKYRRWNIGDRFRSVIDDAWWFGTIESQEPLQLEYPDSLFQCYNVCWDNGDTEKMSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYRRVSSLMWEVRYIEHNTRTFNEPGSPIVKSAKFVTDLLLHFIK

SEQ ID NO: 870019 - protein, 1051 aa, Homo sapiens
LLATLRGHAAEISDMAVNYENTMIAAGSCDKMIRVWCLRTCAPLAVLQGHSASITSLQFSPLCSGSKRYLSSTGADGTICFWLWDAGTLKINPRPAKFTERPRPGVQMICSSFSAGGMFLATGSTDHIIRVYFFGSGQPEKISELEFHTDKVDSIQFSNTSNRFVSGSRDGTARIWQFKRREWKSILLDMATRPAGQNLQGIEDKITKMKVTMVAWDRHDNTVITAVNNMTLKVWNSYTGQLIHVLMGHEDEVFVLEPHPFDPRVLFSAGHDGNVIVWDLARGVKIRSYFNMIEGQGHGAVFDCKCSPDGQHFACTDSHGHLLIFGFGSSSKYDKIADQMFFHSDYRPLIRDANNLYVDEQTQQSTSSYASPFLVDVDGNPHPSRYQRLVPGRENCREEQLIPQMGVTSSGLNQVLSQQANQEISPLDSMIQRLQQEQDLRRSGEAGISNTSRLSRGSISSTSEVHSPPNVGLRRSGQIEGVRQMHSNAPRSEIATERDLVAWSRRVVVPELSAGVASRQEEWRTAKGEEEIKTYRSEEKRKHLTVPKENKIPTVSKNHAHEHFLDLGESKKQQTNQHNYRTRSALEETPRPSEEIENGSSSSDEGEVVAVSGGTSEEEERAWHSDGSSSDYSSDYSDWTADAGINLQPPKKVPKNKTKKAESSSDEEEESEKQKQKQIKKEKKKVNEEKDGPISPKKKKPKERKQKRLAVGELTENGLTLEEWLPSTWITDTIPRRCPFVPQMGDEVYYFRQGHEAYVEMARKNKIYSINPKKQPWHKMELREQELMKIVGIKYEVGLPTLCCLKLAFLDPDTGKLTGGSFTMKYHDMPDVIDFLVLRQQFDDAKYRRWNIGDRFRSVIDDAWWFGTIESQEPLQLEYPDSLFQCYNVCWDNGDTEKMSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYSGDLSTHLLIFSSVSQLFVYRNAHKIMGIMLKCRILFSRFGVGPEILHF

SEQ ID NO: 870020 - protein, 707 aa, Homo sapiens
MSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYRRVSSLMWEVRYIEHNTRTFNEPGSPIVKSAKFVTDLLLHFIKDQTCYNIIPLYNSMKKKVLSDSEDEEKDADVPGTSTRKRKDHQPRRRLRNRAQSYDIQAWKKQCEELLNLIFQCEDSEPFRQPVDLLEYPDYRDIIDTPMDFATVRETLEAGNYESPMELCKDVRLIFSNSKAYTPSKRSRIYSMSLRLSAFFEEHISSVLSDYKSALRFHKRNTITKRRKKRNRSSSVSSSAASSPERKKRILKPQLKSESSTSAFSTPTRSIPPRHNAAQINGKTESSSVVRTRSNRVVVDPVVTEQPSTSSAAKTFITKANASAIPGKTILENSVKHSKALNTLSSPGQSSFSHGTRNNSAKENMEKEKPVKRKMKSSVLPKASTLSKSSAVIEQGDCKNNALVPGTIQVNGHGGQPSKLVKRGPGRKPKVEVNTNSGEIIHKKRGRKPKKLQYAKPEDLEQNNVHPIRDEVLPSSTCNFLSETNNVKEDLLQKKNRGGRKPKRKMKTQKLDADLLVPASVKVLRRSNRKKIDDPIDEEEEFEELKGSEPHMRTRNQGRRTAFYNEDDSEEEQRQLLFEDTSLTFGTSSRGRVRKLTEKAKANLIGW

SEQ ID NO: 870021 - protein, 1045 aa, Homo sapiens; identical to SEQ ID NO: 870018

SEQ ID NO: 870022 - protein, 1605 aa, Homo sapiens
LLATLRGHAAEISDMAVNYENTMIAAGSCDKMIRVWCLRTCAPLAVLQGHSASITSLQFSPLCSGSKRYLSSTGADGTICFWLWDAGTLKINPRPAKFTERPRPGVQMICSSFSAGGMFLATGSTDHIIRVYFFGSGQPEKISELEFHTDKVDSIQFSNTSNRFVSGSRDGTARIWQFKRREWKSILLDMATRPAGQNLQGIEDKITKMKVTMVAWDRHDNTVITAVNNMTLKVWNSYTGQLIHVLMGHEDEVFVLEPHPFDPRVLFSAGHDGNVIVWDLARGVKIRSYFNMIEGQGHGAVFDCKCSPDGQHFACTDSHGHLLIFGFGSSSKYDKIADQMFFHSDYRPLIRDANNLYVDEQTQQSTSSYASPFLVDVDGNPHPSRYQRLVPGRENCREEQLIPQMGVTSSGLNQVLSQQANQEISPLDSMIQRLQQEQDLRRSGEAGISNTSRLSRGSISSTSEVHSPPNVGLRRSGQIEGVRQMHSNAPRSEIATERDLVAWSRRVVVPELSAGVASRQEEWRTAKGEEEIKTYRSEEKRKHLTVPKENKIPTVSKNHAHEHFLDLGESKKQQTNQHNYRTRSALEETPRPSEEIENGSSSSDEGEVVAVSGGTSEEEERAWHSDGSSSDYSSDYSDWTADAGINLQPPKKVPKNKTKKAESSSDEEEESEKQKQKQIKKEKKKVNEEKDGPISPKKKKPKERKQKRLAVGELTENGLTLEEWLPSTWITDTIPRRCPFVPQMGDEVYYFRQGHEAYVEMARKNKIYSINPKKQPWHKMELREQELMKIVGIKYEVGLPTLCCLKLAFLDPDTGKLTGGSFTMKYHDMPDVIDFLVLRQQFDDAKYRRWNIGDRFRSVIDDAWWFGTIESQEPLQLEYPDSLFQCYNVCWDNGDTEKMSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYRRVSSLMWEVRYIEHNTRTFNEPGSPIVKSAKFVTDLLLHFIKDQTCYNIIPLYNSMKKKVLSDSEDEEKDADVPGTSTRKRKDHQPRRRLRNRAQSYDIQAWKKQCEELLNLIFQCEDSEPFRQPVDLLEYPDYRDIIDTPMDFATVRETLEAGNYESPMELCKDVRLIFSNSKAYTPSKRSRIYSMSLRLSAFFEEHISSVLSDYKSALRFHKRNTITKRRKKRNRSSSVSSSAASSPERKKRILKPQLKSESSTSAFSTPTRSIPPRHNAAQINGKTESSSVVRTRSNRVVVDPVVTEQPSTSSAAKTFITKANASAIPGKTILENSVKHSKALNTLSSPGQSSFSHGTRNNSAKENMEKEKPVKRKMKSSVLPKASTLSKSSAVIEQGDCKNNALVPGTIQVNGHGGQPSKLVKRGPGRKPKVEVNTNSGEIIHKKRGRKPKKLQYAKPEDLEQNNVHPIRDEVLPSSTCNFLSETNNVKEDLLQKKNRGGRKPKRKMKTQKLDADLLVPASVKVLRRSNRKKIDDPIDEEEEFEELKGSEPHMRTRNQGRRTAFYNEDDSEEEQRQLLFEDTSLTFGTSSRGRVRKLTEKAKANLIGW

SEQ ID NO: 870023 - protein, 1045 aa, Homo sapiens; identical to SEQ ID NO: 870018

SEQ ID NO: 870024 - protein, 1024 aa, Homo sapiens
LLATLRGHAAEISDMAVNYENTMIAAGSCDKMIRVWCLRTCAPLAVLQGHSASITSLQFSPLCSGSKRYLSSTGADGTICFWLWDAGTLKINPRPAKFTERPRPGVQMICSSFSAGGMFLATGSTDHIIRVYFFGSGQPEKISELEFHTDKVDSIQFSNTSNRFVSGSRDGTARIWQFKRREWKSILLDMATRPAGQNLQGIEDKITKMKVTMVAWDRHDNTVITAVNNMTLKVWNSYTGQLIHVLMGHEDEVFVLEPHPFDPRVLFSAGHDGNVIVWDLARGVKIRSYFNMIEGQGHGAVFDCKCSPDGQHFACTDSHGHLLIFGFGSSSKYDKIADQMFFHSDYRPLIRDANNLYVDEQTQQSTSSYASPFLVDVDGNPHPSRYQRLVPGRENCREEQLIPQMGVTSSGLNQVLSQQANQEISPLDSMIQRLQQEQDLRRSGEAGISNTSRLSRGSISSTSEVHSPPNVGLRRSGQIEGVRQMHSNAPRSEIATERDLVAWSRRVVVPELSAGVASRQEEWRTAKGEEEIKTYRSEEKRKHLTVPKENKIPTVSKNHAHEHFLDLGESKKQQTNQHNYRTRSALEETPRPSEEIENGSSSSDEGEVVAVSGGTSEEEERAWHSDGSSSDYSSDYSDWTADAGINLQPPKKVPKNKTKKAESSSDEEEESEKQKQKQIKKEKKKVNEEKDGPISPKKKKPKERKQKRLAVGELTENGLTLEEWLPSTWITDTIPRRCPFVPQMGDEVYYFRQGHEAYVEMARKNKIYSINPKKQPWHKMELREQELMKIVGIKYEVGLPTLCCLKLAFLDPDTGKLTGGSFTMKYHDMPDVIDFLVLRQQFDDAKYRRWNIGDRFRSVIDDAWWFGTIESQEPLQLEYPDSLFQCYNVCWDNGDTEKMSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYSRLEPFDVATIKGKLVIFPPIY

SEQ ID NO: 870025 - protein, 315 aa, Homo sapiens [sequence omitted]

SEQ ID NO: 870026 - protein, 315 aa, Homo sapiens [sequence omitted]

SEQ ID NO: 870027 - protein, 143 aa, Homo sapiens
MFPVLGWILIAVVIIILLIFTSVTRCLSPVSFLQLKFWKIYLEQEQQILKSKATEHATELAKENIKCFFEGSHPKEYNTPSMKEWQQISSLYTFNPKGQYYSMLHKYVNRKEKTHSIRSTEGDTVIPVLGFVDSSGINSTPEL

SEQ ID NO: 870028 - protein, 284 aa, Homo sapiens
MAPRLCSISVTARRLLGGPGPRAGDVASAAAARFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKYRQENQEAVGGFFSQIGELYVVHHLWAYKDLQSREETRNAAWRKRGWDENVYYTVPLVRHMESRIMIPLKISPLQ

SEQ ID NO: 870029 - protein, 284 aa, Homo sapiens; identical to SEQ ID NO: 870028

SEQ ID NO: 870030 - protein, 254 aa, Homo sapiens
MTGFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKYRQENQEAVGGFFSQIGELYVVHHLWAYKDLQSREETRNAAWRKRGWDENVYYTVPLVRHMESRIMIPLKISPLQ

SEQ ID NO: 870031 - protein, 284 aa, Homo sapiens; identical to SEQ ID NO: 870028

SEQ ID NO: 870032 - protein, 284 aa, Homo sapiens; identical to SEQ ID NO: 870028

SEQ ID NO: 870033 - protein, 147 aa, Homo sapiens
RTNNYVLGTRPGVNLAEANMAPRLCSISVTARRLLGGPGPRAGDVASAAAARFYSKDNEGSWFRSLFVHKVDPRKDAHSTLLSKKETSNLYKIQFHNVKPEYLDAYNSLTEAVLPKLHLDEDYPCSLVGNWNTWSCCLGFVLALGGL

SEQ ID NO: 870034 - protein, 104 aa, Homo sapiens
RTNNYVLGTRPGVNLAEANMAPRLCSISVTARRLLGGPGPRAGDVASAAAARFYSKDNEGSWFRSLFVHKVDPRKDAHSTLPRPFLLSLPASLPLLEVVSDFPE

SEQ ID NO: 870035 - protein, 284 aa, Homo sapiens; identical to SEQ ID NO: 870028

SEQ ID NO: 870036 - protein, 66 aa, Homo sapiens
EDPHYHVVYEELVCHLRIATGALRVACSRYHVFQLPTVSMGSPHPGEAWMRTAQRGWGKGWEPGKI

SEQ ID NO: 870037 - protein, 229 aa, Homo sapiens
MAPRLCSISVTARRLLGGPGPRAGDVASAAAARLPPSEGSGLCMVKEYLPKNFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKY

SEQ ID NO: 870038 - protein, 80 aa, Homo sapiens
PQPRMGPNIYELRTYKLKQDQAVHLWRFSGGYPALMDCMNKLKNNKEYLRSLFVHKVDPRKDAHSTLLSKKETSNLYKIQ

SEQ ID NO: 870039 - protein, 189 aa, Homo sapiens
METPTGNAHLTGFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKY

SEQ ID NO: 870040 - protein, 284 aa, Homo sapiens; identical to SEQ ID NO: 870028

SEQ ID NO: 870041 - protein, 260 aa, Homo sapiens
MVKEYLPKNFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKYRQENQEAVGGFFSQIGELYVVHHLWAYKDLQSREETRNAAWRKRGWDENVYYTVPLVRHMESRIMIPLKISPLQ

SEQ ID NO: 870042 - protein, 264 aa, Homo sapiens
MLPPLSLPESWDYRRELVPNSARVRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKYRQENQEAVGGFFSQIGELYVVHHLWAYKDLQSREETRNAAWRKRGWDENVYYTVPLVRHMESRIMIPLKISPLQ

SEQ ID NO: 870043 - protein, 147 aa, Homo sapiens
MAPRLCSISVTARRLLGGPGPRAGDVASAAAARFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPAQEKPAAPRVQLLE

SEQ ID NO: 870044 - protein, 95 aa, Homo sapiens
PQPRMGPNIYELRTYKLKQDQAVHLWRFSGGYPALMDCMNKLKNNKEYLRSLFVHKVDPRKDAHSTLLSKKETSNLYKIQFHNVKPEYLEEERLG

SEQ ID NO: 870045 - protein, 325 aa, Homo sapiens
MAPRLCSISVTARRLLGGPGPRAGDVASAAAARFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKYRQENQEAVGGFFSQIGELYVVHHLWAYKDLQSREETRNAAWRKRGWDENVYYTVPLVRHMESRIMIPLKISPCILSPLIDILSAQPSFCRATWCVEVAGGVSDSGGLLSDPHTSS

SEQ ID NO: 870046 - protein, 276 aa, Homo sapiens
MAPRLCSISVTARRLLGGPGPRAGDVASAAAARFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKDVSVHSAHLSGCGMQPSPVLGTTLLPHEAHCQDGAHFLVAMPLPPCPQDSLFVHKVDPRKDAHSTLLSKKETSNLYKIQFHNVKPEYLDAYNSLTEAVLPKLHLDEDYPCSLVGNWNTWSCSSRALPRRP

SEQ ID NO: 870047 - protein, 93 aa, Homo sapiens
EAVLPKLHLDEDYPCSLVGNWNTWYGEQDQAGKALTSLVPLPLPSPGLQHLSHLAVLHSLSTTAPGGALTKTSSPHSPAQIPVLAPLCPQGDP

SEQ ID NO: 870048 - protein, 453 aa, Homo sapiens [sequence omitted]

SEQ ID NO: 870049 - protein, 394 aa, Homo sapiens
MGKAKVKKMNHVTKKKKLPMELCLALPYCKHYGKAKAGKLEARAALNQALEMKRQGKREKAQKLFMHALKMDPDFVDALTEFGIFSEEDKDIIQADYLYTRALTISPYHEKALVNRDRTLPLVEEIDQRYFSIIDSKVKKVMSIPKGNSALRRVMEETYYHHIYHTVAIEGNTLTLSEIRHILETRYAVPGKSLEEQNEVIGMHAAMKYINTTLVSRIGSVTISDVLEIHRRVLGYVDPVEAGRFRTTQVLVGHHIPPHPQDVEKQMQEFVQWLNSEEAMNLHPVEFAALAHYKLVYIHPFIDGNGRTSRLLMNLILMQAGYPPITIRKEQRSDYYHVLEAANEGDVRPFIRFIAKCTETTLDTLLFATTEYSVALPEAQPNHSGFKETLPVKP

SEQ ID NO: 870050 - protein, 105 aa, Homo sapiens
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPGKCCT

SEQ ID NO: 870051 - protein, 453 aa, Homo sapiens [sequence omitted]

SEQ ID NO: 870052 - protein, 453 aa, Homo sapiens [sequence omitted]

SEQ ID NO: 870053 - protein, 122 aa, Homo sapiens
MASVMAVTEPKWVSVWSRFLWVTLLSMVLGSLLALLLPLGAVEEQCLAVLKGLYLLRSKPDRAQHAATKCTSPSTELSITSRGATLLVAKTKASPETRYWRKLGEGSTQDFSVLFLQLPMTL

SEQ ID NO: 870054 - protein, 98 aa, Homo sapiens
FSTVEKTLLSLLNFHDLFAENQFTINVSVYFWTVGSMPLIYMTVLMPALCCLDYCSFGVSFDIGKSESSNDVCHFQDYFGCSGFMICLSITEKKKARL

SEQ ID NO: 870055 - protein, 125 aa, Homo sapiens
MGAEAPTPACENGVLSHLGEPGAAPRRMHLWLREVFPDPRCCLTIETKSHYVAQAGLELLASSDPPTSASQSVGIIDMSHCTWPTLGKFLNPSKPHFSPITKGKDGNIFPTKFLSDALTELRLCT

SEQ ID NO: 870056 - protein, 456 aa, Homo sapiens
PPLDSGGFVLGLRPRSRGGRGRASGREPRRLRLPGALTAAVMRIPVDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 870057 - protein, 465 aa, Homo sapiens
PLPPPGPCAGAGWLLVLPTPGRPRTHQSLGSVKERGMASNSIFDSFPTYSPTFIRDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 870058 - protein, 198 aa, Homo sapiens
GWYASENGIVDGPREPRRTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 870059 - protein, 415 aa, Homo sapiens
MRIPVDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 870060 - protein, 415 aa, Homo sapiens; identical to SEQ ID NO: 870059

SEQ ID NO: 870061 - protein, 415 aa, Homo sapiens; identical to SEQ ID NO: 870059

SEQ ID NO: 870062 - protein, 429 aa, Homo sapiens
MASNSIFDSFPTYSPTFIRDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 870063 - protein, 306 aa, Homo sapiens
MAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 870064 - protein, 429 aa, Homo sapiens; identical to SEQ ID NO: 870062

SEQ ID NO: 870065 - protein, 137 aa, Homo sapiens
MHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTP

SEQ ID NO: 870066 - protein, 366 aa, Homo sapiens
GLAISKDFWGTVGYREKPQASESSMPVPCPPLDSLPELQRESSLEDPSRYKPQWECRENSGNLWAFESPVLDLNPELSGTSPECVPPASETPWKGMQSRENIWVPADPVSPPSLPSVPLLESLVMGPQGVLSESKALWETMGQKENLWASDSPDPVHSTPPTTLMEPHRINPGECLATSEATWKDTEHSRNSSASRSPSLALSPPPALAPELLRVRSMGVLSDSEARCGDIQKTKNSWASKHPACNLPQDLHGASPLGVLSDSQSIVGEMEQKENCVPVFPGRGSSPSSNSVSKSHVSEPIADQSNYKPDGEAVEQRKNHWATELPAPSSLSTPLPEPHIDLELVWRNVQQREVPQGPSPLAVDPL

SEQ ID NO: 870067 - protein, 888 aa, Homo sapiens
DSGPRPPAAPAPFPPGPPMMPPPFMPPPGIPPPFPPMGLPPMSQRPPAIPPMPPGILPPMLPPMGAPPPLTQIPGMVPPMMPGMLMPAVPVTAATAPGADTASSAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSNASWEQAMKMVVTDPRYSALPKLSEKKQAFNAYKAQREKEEKEEARLRAKEAKQTLQHFLEQHERMTSTTRYRRAEQTFGELEVWAVVPERDRKEVYDDVLFFLAKKEKEQAKQLRRRNIQALKSILDGMSSVNFQTTWSQAQQYLMDNPSFAQDHQLQNMDKEDALICFEEHIRALEREEEEERERARLRERRQQRKNREAFQTFLDELHETGQLHSMSTWMELYPAVSTDVRFANMLGQPGSTPLDLFKFYVEELKARFHDEKKIIKDILKDRGFCVEVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLETECQHLHTKGRKHGRKGKKHHHKRSHSPSGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 870068 - protein, 888 aa, Homo sapiens; identical to SEQ ID NO: 870067

SEQ ID NO: 870069 - protein, 356 aa, Homo sapiens
MRTWITWFLMQTQSCGSLPEARAFLTICNVTTLPASFGLRHVVPLLHALLYPQDRGFCVEVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLETECQHLHTKGRKHGRKGKKHHHKRSHSPSGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 870070 - protein, 161 aa, Homo sapiens
MAGKGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 870071 - protein, 115 aa, Homo sapiens
MRGGPEVILTPPPTCPADFREGRKLKKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 870072 - protein, 386 aa, Homo sapiens
DSGPRPPAAPAPFPPGPPMMPPPFMPPPGIPPPFPPMGLPPMSQRPPAIPPMPPGILPPMLPPMGAPPPLTQIPGMVPPMMPGMLMPAVPVTAATAPGADTASSAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSSSSVCFLSPLRQVGPPCQPSPAPICSSLGWRRVKETEKRAPSLPPAPFPPDPIQVLSQKRYVIMHFTDEGRGRS

SEQ ID NO: 870073 - protein, 98 aa, Homo sapiens
EEVGSGLLQNSPESETDPEEKAGKESDEKEQEQDKDRELQQAELPNRSPGFGIKKEKVRGRGPRPVSTLVKLPRPLVQAKGELCLCSNRQAGTRQKVS

SEQ ID NO: 870074 - protein, 173 aa, Homo sapiens
SLFPQLGGGSGGGSARGYCRQVSVSLHPGTGLFSPFCSVPLCVFTFSLFALFSAFHLHLFISASLACISSILIVPASSSAIPSLPPQSVALPPCLTLPITGLSLLRPSWTSCMRQGSCTLCPPGWSYIQQSALMSALPTCWASRVRQPGSPFSGLASCPASLSAPPTTGSCPR

SEQ ID NO: 870075 - protein, 888 aa, Homo sapiens; identical to SEQ ID NO: 870067

SEQ ID NO: 870076 - protein, 803 aa, Homo sapiens
NKMEVGARTEYVSFGFFLAAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSNASWEQAMKMVVTDPRYSALPKLSEKKQAFNAYKAQREKEEKEEARLRAKEAKQTLQHFLEQHERMTSTTRYRRAEQTFGELEVWAVVPERDRKEVYDDVLFFLAKKEKEQAKQLRRRNIQALKSILDGMSSVNFQTTWSQAQQYLMDNPSFAQDHQLQNMDKEDALICFEEHIRALEREEEEERERARLRERRQQRKNREAFQTFLDELHETGQLHSMSTWMELYPAVSTDVRFANMLGQPGSTPLDLFKFYVEELKARFHDEKKIIKDILKDRGFCVEVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLETECQHLHTKGRKHGRKGKKHHHKRSHSPSGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 870077 - protein, 936 aa, Homo sapiens
DSGPRPPAAPAPFPPGPPMMPPPFMPPPGIPPPFPPMGLPPMSQRPPAIPPMPPGILPPMLPPMGAPPPLTQIPGMVPPMMPGMLMPAVPVTAATAPGADTASSAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSNASWEQAMKMVVTDPRYSALPKLSEKKQAFNAYKAQREKEEKEEARLRAKEAKQTLQHFLEQHERMTSTTRYRRAEQTFGELEVWAVVPERDRKEVYDDVLFFLAKKEKEQAKQLRRRNIQALKSILDGMSSVNFQTTWSQAQQYLMDNPSFAQDHQLQNMDKEDALICFEEHIRALEREEEEERERARLRERRQQRKNREAFQTFLDELHETGQLHSMSTWMELYPAVSTDVRFANMLGQPGKAARLPLLWPGFLPCQPLCTPYYRLLSSAQPPGLGKLAARQAPLPPSGSTPLDLFKFYVEELKARFHDEKKIIKDILKDRGFCVEVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLETECQHLHTKGRKHGRKGKKHHHKRSHSPSGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 870078 - protein, 530 aa, Homo sapiens
DSGPRPPAAPAPFPPGPPMMPPPFMPPPGIPPPFPPMGLPPMSQRPPAIPPMPPGILPPMLPPMGAPPPLTQIPGMVPPMMPGMLMPAVPVTAATAPGADTASSAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSNASWEQAMKMVVTDPRYSALPKLSEKKQAFNAYKAQREKEEKEEARLRAKEAKQTLQHFLEQHERMTSTTRYRRAEQTFGELEVWAVVPERDRKEVYDDVLFFLAKKEKEQAKQLRRRNIQALKSILDGMSSVNFQTTWSQAQQYLMDNPSFAQDHQLQNMDKEDALICFEEHIRALEREEEEERERARLRERRQQRKNREAFQVSLLSFLDQSSALP

SEQ ID NO: 870079 - protein, 72 aa, Homo sapiens
HALLYPQDRGFCVEVNTAFEDFAHVISFDKRAAALDAGNIKLTFNSVRGWAGRGKFSNSSVSCSIPSHSLSH

SEQ ID NO: 870080 - protein, 154 aa, Homo sapiens
MGSKCCKGGPDEDAVERQRRQKLLLAQLHHRKRVKAAGQIQAWWRGVLVRRTLLVAALRAWMIQCWWRTLVQRRIRQRRQALLRVYVIQEQATVKLQSCIRMWQCRQCYRQMCNALCLFQVPESSLAFQTDGFLQVQYAIPSKQPEFHIEILSI

SEQ ID NO: 870081 - protein, 138 aa, Homo sapiens
SALLGQLLLAQLHHRKRVKAAGQIQAWWRGVLVRRTLLVAALRAWMIQCWWRTLVQRRIRQRRQALLRVYVIQEQATVKLQSCIRMWQCRQCYRQMCNALCLFQVPESSLAFQTDGFLQVQYAIPSKQPEFHIEILSI

SEQ ID NO: 870082 - protein, 551 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEVRGK

SEQ ID NO: 870083 - protein, 2818 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 870084 - protein, 2818 aa, Homo sapiens; identical to SEQ ID NO: 870083

SEQ ID NO: 870085 - protein, 2839 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 870086 - protein, 2692 aa, Homo sapiens
WRLPIYSIRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 870087 - protein, 2263 aa, Homo sapiens
MLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 870088 - protein, 623 aa, Homo sapiens [sequence omitted]

SEQ ID NO: 870089 - protein, 140 aa, Homo sapiens
MSTTCPSSPCEPMRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 870090 - protein, 2706 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSK

SEQ ID NO: 870091 - protein, 593 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEIRYMYFYFLNSTFKFYFVFLS

SEQ ID NO: 870092 - protein, 1577 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLTPPPEPET

SEQ ID NO: 870093 - protein, 106 aa, Homo sapiens
QQEITILVKSDKKLKRQFKIKLKGNIGVNVGREKGRELHKNARTMEGRWVEHSSCNGEAFQRNRERESCEDWIDLISHSALFKRVWKCTVFKQTSHTMKAGLSSWW

SEQ ID NO: 870094 - protein, 2818 aa, Homo sapiens; identical to SEQ ID NO: 870083

SEQ ID NO: 870095 - protein, 2818 aa, Homo sapiens; identical to SEQ ID NO: 870083

SEQ ID NO: 870096 - protein, 2836 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPASLPCSKSAVFMQLFPHQGIDKENVELSPTTGHCNSGRTRHGSASQVQKQRSAGSFKRNSIKKIV

SEQ ID NO: 870097 - protein, 479 aa, Homo sapiens [sequence omitted]

SEQ ID NO: 870098 - protein, 2794 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGQ

SEQ ID NO: 870099 - protein, 2418 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKVSKLCLEVPRLLKFSTLPSFLVAILLKSQEVHNLSRNLYNVTYCEYISLPAHKELCKLECIFFT

SEQ ID NO: 870100 - protein, 1413 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVSLENFLLAVSFKAKQKSFAVC

SEQ ID NO: 870101 - protein, 350 aa, Homo sapiens
MEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIFVENTVDLEGPPSDFYYINEYKPAPGISLVNEATFGCSCTDCFFQKCCPAEAGVLLAYNKNQQIKIPPGTPIYECNSRCQCGPDCPNRIVQKGTQYSLCIFRTSNGRGWGVKTLVKIKRMSFVMEYVGEVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 870102 - protein, 230 aa, Homo sapiens
MAAVGAEARGAWCVPCLVSLDTLQELCRKEKLTCKSIGITKRNLNNYEVEYLCDYKVVKDMEYYLVKWKGWPDSTNTWEPLQNLKCPLLLQQFSNDKHNYLSQVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 870103 - protein, 263 aa, Homo sapiens [sequence omitted]

SEQ ID NO: 870104 - protein, 263 aa, Homo sapiens [sequence omitted]

SEQ ID NO: 870105 - protein, 263 aa, Homo sapiens [sequence omitted]

SEQ ID NO: 870106 - protein, 263 aa, Homo sapiens [sequence omitted]

SEQ ID NO: 870107 - protein, 350 aa, Homo sapiens; identical to SEQ ID NO: 870101

SEQ ID NO: 870108 - protein, 137 aa, Homo sapiens [sequence omitted]

SEQ ID NO: 870109 - protein, 323 aa, Homo sapiens
MAAVGAEARGAWCVPCLVSLDTLQELCRKEKLTCKSIGITKRNLNNYEVEYLCDYKVVKDMEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIFVENTVDLEGPPSDFYYINEYKPAPGISLVNEATFGCSCTDCFFQKCCPAEAGVLLAYNKNQQIKIPPGTPIYECNSRCQCGPDCPNRIVQKGTQYSLCIFRTSNGRGWGVKTLVKIKRMSFVMEYVGEVCFICHVVNDGHARFILLENYLFISLRDTWYILIFSFADM

SEQ ID NO: 870110 - protein, 263 aa, Homo sapiens [sequence omitted]

SEQ ID NO: 870111 - protein, 311 aa, Homo sapiens
MESRPPPSPPPPSSSSSSSSSSSHPGSLPKPLGLQPLPRPEVSFLTEYLRKLKACEGGGVEIAAASFPRIYLMGMCSRQDRIQKDIDVVIQKSRAEDCLFAGEFLLFQNLGPSAPFSVLRPRRVWLGVGWRVCTSAFRGSFGNSCCNERGSQKREGAPASPLPLPPPPSLGQLPALRAEPAWPERGSRRRGSAWYFQPRVVPEACKHASWVPAAAAERGWLDPPGLRNGLSGGGREWSLLRCARKLRPAPRTPGGQRSAHLRPLRLHLVPSDWQREGIPRIPKAPSAPAWGVAFRPFCSPGREIGFCFRCR

SEQ ID NO: 870112 - protein, 108 aa, Homo sapiens
MESRPPPSPPPPSSSSSSSSSSSHPGSLPKPLGLQPLPRPEVSFLTEYLRKLKACEGGGVEIAAASFPRIYLMGMCSRQDRIQKDIDVVIQKSRAEDCLFAGPAWQDD

SEQ ID NO: 870113 - protein, 108 aa, Homo sapiens; identical to SEQ ID NO: 870112

SEQ ID NO: 870114 - protein, 108 aa, Homo sapiens; identical to SEQ ID NO: 870112

SEQ ID NO: 870115 - protein, 108 aa, Homo sapiens; identical to SEQ ID NO: 870112

SEQ ID NO: 870116 - protein, 108 aa, Homo sapiens; identical to SEQ ID NO: 870112

SEQ ID NO: 870117 - protein, 135 aa, Homo sapiens
MESRPPPSPPPPSSSSSSSSSSSHPGSLPKPLGLQPLPRPEVSFLTEYLRKLKACEGGGVEIAAASFPRIYLMGMCSRQDRIQKDIDVVIQKSRAEDCLFAGRWSGRGAVGRERGKGKQKLEKKQGSCEPDIQTS

SEQ ID NO: 870118 - protein, 128 aa, Homo sapiens
MESRPPPSPPPPSSSSSSSSSSSHPGSLPKPLGLQPLPRPEVSFLTEYLRKLKACEGGGVEIAAASFPRIYLMGMCSRQDRIQKDIDVVIQKSRAEDCLFADFRYSDSTFTFTYVGGPRSFKSSRNFI

SEQ ID NO: 870119 - protein, 128 aa, Homo sapiens; identical to SEQ ID NO: 870118

SEQ ID NO: 870120 - protein, 110 aa, Homo sapiens
MESRPPPSPPPPSSSSSSSSSSSHPGSLPKPLGLQPLPRPEVSFLTEYLRKLKACEGGGVEIAAASFPRIYLMGMCSRQDRIQKDIDVVIQKSRAEDCLFAAVIQSPQDG

SEQ ID NO: 870121 - protein, 70 aa, Homo sapiens
AGAAASPPAASPRKSSRAVGASLGPLVGTESRSCVLGLGWLLDAREASDLACKGARLAGRLSKFLENQRY

SEQ ID NO: 870122 - protein, 70 aa, Homo sapiens; identical to SEQ ID NO: 870121

SEQ ID NO: 870123 - protein, 389 aa, Homo sapiens
MGGERGEGSRSGARPSSAPAAQPVIALRPSPAPSAPHGGWSGRGKEKVRLGFITNPSPEGEEIGIQQRRAAAGRSHLEMESRPPPSPPPPSSSSSSSSSSSHPGSLPKPLGLQPLPRPEVSFLTEYLRKLKACEGGGVEIAAASFPRIYLMGMCSRQDRIQKDIDVVIQKSRAEDCLFAGEFLLFQNLGPSAPFSVLRPRRVWLGVGWRVCTSAFRGSFGNSCCNERGSQKREGAPASPLPLPPPPSLGQLPALRAEPAWPERGSRRRGSAWYFQPRVVPEACKHASWVPAAAAERGWLDPPGLRNGLSGGGREWSLLRCARKLRPAPRTPGGQRSAHLRPLRLHLVPSDWQREGIPRIPKAPSAPAWGVAFRPFCSPGREIGFCFRCR

SEQ ID NO: 870124 - protein, 300 aa, Homo sapiens
MGKITSSSSSSSHPGSLPKPLGLQPLPRPEVSFLTEYLRKLKACEGGGVEIAAASFPRIYLMGMCSRQDRIQKDIDVVIQKSRAEDCLFAGEFLLFQNLGPSAPFSVLRPRRVWLGVGWRVCTSAFRGSFGNSCCNERGSQKREGAPASPLPLPPPPSLGQLPALRAEPAWPERGSRRRGSAWYFQPRVVPEACKHASWVPAAAAERGWLDPPGLRNGLSGGGREWSLLRCARKLRPAPRTPGGQRSAHLRPLRLHLVPSDWQREGIPRIPKAPSAPAWGVAFRPFCSPGREIGFCFRCR

SEQ ID NO: 870125 - protein, 108 aa, Homo sapiens; identical to SEQ ID NO: 870112

SEQ ID NO: 870126 - protein, 135 aa, Homo sapiens
MESRPPPSPPPPPPPPPPPPPPLTQDHFRNHLAFSPCLGQRVTCKRDSIYAGSCEAVRTCAAGRWNIVVLASFIRRHFTFKWRHAGSDGKHPTFRNGYSTVDASQRGSRSMRDVAVRRGARLAGRLSKFLENQRY

SEQ ID NO: 870127 - protein, 108 aa, Homo sapiens; identical to SEQ ID NO: 870112

SEQ ID NO: 870128 - protein, 128 aa, Homo sapiens
MESRPPPSPPPPSSSSSSSSSSSHPGSLPKPLGLQPLPRPEVSFLTEYLRKPGGLPGWFFRFFVPPSPSEGACIHPAQSLLGCCGASAAIFGSCVPPGAPPGQGWCRMGKWRENLKEPQTRGPIAPQE

SEQ ID NO: 870129 - protein, 110 aa, Homo sapiens
MESRPPPSPPPPSSSSSSSSSSSHPGSLPKPLGLQPLPRPEVSFLTEYLRKLKACEGGGVEIAAASFPRIYLMGMCSRQDRIQKDIDVVIQKSRAEDCLFAAEWGNGERT

SEQ ID NO: 870130 - protein, 124 aa, Homo sapiens
MESRPPPSPPPPSSSSSSSSSSSHPGSLPKPLGLQPLPRPEVSFLTEYLRKLKACEGGGVEIAAASFPRIYLMGMCSRQDRIQKDIDVVIQKSRAEDCLFADFRYSDSTFTFTYVGGPRRYLWV

SEQ ID NO: 870131 - protein, 759 aa, Homo sapiens
SGSGGGGAATAGAAGLRGCGAAGRGGRAGPGRAPLTAMLTFFLVSGGSLWLFVEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 870132 - protein, 902 aa, Homo sapiens
PYLTLVFNKFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQDLPQCLIQIKVFSKYSFNDSKPEVKPGSKRKGKVHGLSKIAEKAERSRQGGSGSGPFSPRLGVTGEKSLQENRSSEDTQDEKIASLRESVTDDLQVDSSSSNSELVSGLSLHHGMASSLLSYSVTDSYAEYKSFEESFPSPELFRKSDYLDWECPNLEEHMQWKNSTLLDTSKAVAIEKAPQFSNVSAIFSTSSEDYQKCHRKTVMTVADQNVSPKAKCASNSESENKFQYSW

SEQ ID NO: 870133 - protein, 708 aa, Homo sapiens
MPEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 870134 - protein, 697 aa, Homo sapiens
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 870135 - protein, 699 aa, Homo sapiens
VGERGRRGLVRSAAGPLPRPGAWRFRHREFVLSLLEKMQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 870136 - protein, 228 aa, Homo sapiens
MPSCSGVPGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 870137 - protein, 887 aa, Homo sapiens
MSETPAQCSIKFVLSLLEKMQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQDLPQCLIQIKVFSKYSFNDSKPEVKPGSKRKGKVHGLSKIAEKAERSRQGGSGSGPFSPRLGVTGEKSLQENRSSEDTQDEKIASLRESVTDDLQVDSSSSNSELVSGLSLHHGMASSLLSYSVTDSYAEYKSFEESFPSPELFRKSDYLDWECPNLEEHMQWKNSTLLDTSKAVAIEKAPQFSNVSAIFSTSSEDYQKCHRKTVMTVADQNVSPKAKCASNSESDNAACEILLAEKTCPSTPEKTKKKAN

SEQ ID NO: 870138 - protein, 869 aa, Homo sapiens
MSETPAQCSIKFVLSLLEKMQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQDLPQCLIQIKVFSKYSFNDSKPEVKPGSKRKGKVHGLSKIAEKAERSRQGGSGSGPFSPRLGVTGEKSLQENRSSEDTQDEKIASLRESVTDDLQVDSSSSNSELVSGLSLHHGMASSLLSYSVTDSYAEYKSFEESFPSPELFRKSDYLDWECPNLEEHMQWKNSTLLDTSKAVAIEKAPQFSNVSAIFSTSSEDYQKCHRKTVMTVADQNVSPKAKCASNSESENKFQYSW

SEQ ID NO: 870139 - protein, 187 aa, Homo sapiens
MVQTNCSCLFVSPRLGVTGEKSLQENRSSEDTQDEKIASLRESVTDDLQVDSSSSNSELVSGLSLHHGMASSLLSYSVTDSYAEYKSFEESFPSPELFRKSDYLDWECPNLEEHMQWKNSTLLDTSKAVAIEKAPQFSNVSAIFSTSSEDYQKCHRKTVMTVADQNVSPKAKCASNSESENKFQYSW

SEQ ID NO: 870140 - protein, 734 aa, Homo sapiens
SERHLHLGSAPLLTTMLIASSSVSGGFWEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 870141 - protein, 681 aa, Homo sapiens
MSETPAQCSIKFVLSLLEKMQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 870142 - protein, 751 aa, Homo sapiens
VGERGRRGLVRSAAGPLPRPGAWRFRHRGQCGASPRPGRPGCRAGKFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 870143 - protein, 578 aa, Homo sapiens
GSPDYSGRFCAENTNKLISACFTIVLEKSGPQKFSPVGHQWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 870144 - protein, 318 aa, Homo sapiens
MPEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGKQRHADPQPWLPAPFPGGLAGDCWSL

SEQ ID NO: 870145 - protein, 891 aa, Homo sapiens
MSETPAQCSIKFVLSLLEKMQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQDLPQCLIQIKVFSKYSFNDSKPEVKPGSKRKGKVHGLSKIAEKAERSRQGGSGSGPFSPRLGVTGEKSLQENRSSEDTQDEKIASLRESVTDDLQVDSSSSNSELVSGLSLHHGMASSLLSYSVTDSYAEYKSFEESFPSPELFRKSDYLDWECPNLEEHMQWKNSTLLDTSKAVAIEKAPQFSNVSAIFSTSSEDYQKCHRKTVMTVADQNVSPKAKCASNSESDNAACEILLAEKTCPSTPEKTKKKASIEAE

SEQ ID NO: 870146 - protein, 212 aa, Homo sapiens
MQPKGVRQCRERQKRSGGEGKVAAATLAAAWRHGRNGTRGRHGKGLRLRPLRRDGRISGDLSLLRQGRPDRSDSRHTQAAGRSATAWGCQLPPPARRARAPRRGSGAADTRTLTARAPPLRGSPPPSARPPPHPARRGAWATSRARALSARRQRRGWGIASSASRFPWRQSWPGRPRLGNYDSGAPGEAKMPSKGKDKKKGKSKGKDTKLKN

SEQ ID NO: 870147 - protein, 319 aa, Homo sapiens
MPSKGKDKKKGKSKGKDTKKLIKTDESVVDRAKANASLWEARLEVTELSRIKYRDTSRILAKSNEDLKKKQCKMEKDIMSVLSYLKKQDQEKDNMIEKLKQQLNETKEKAQEEKDKLEQKYTRQINELEGQFHQKAKEIGMIHTELKAVRQFQKRKIQVERELDDLKENLRNTERIHQETLRRLESRFFEEKHRLEQEAEKKIIMLAERAHHEAIVQLNDAGRNVFKENDYLQKALAYHLKETDALQKNSQKLQESHTLLLHQKVPSHLDLVSFFSLFKDWVGKYQKLGIIMIYKDNETIFICLDDALFLSEKVKYSIL

SEQ ID NO: 870148 - protein, 212 aa, Homo sapiens; identical to SEQ ID NO: 870146

SEQ ID NO: 870149 - protein, 54 aa, Homo sapiens
WKVLPKKVFCFYASTFLVFWLGEQTFFGAFQSITDSTSKMEPSSAPCEEYAGNN

SEQ ID NO: 870150 - protein, 133 aa, Homo sapiens
QTAFRLQETSSQSYVEEQKQLKESFRAFVEDSEDEDGAGEGGSSLLQKRAKTRQEKAQEEADYIEWLKGQKEIRNPDSLKELKKVRPMYLKDYERKVILEKAGKYVDEENSDGETSNHRLQETSSQSYVEEPD

SEQ ID NO: 870151 - protein, 126 aa, Homo sapiens
RFCGGTLRPHQAAIKGWQLPLWAGFISLWLPCGFGLSTEEILAADDKELNRWCSLKKTCMYRSEQEELRDKRAYSQKAQNSWKKRQVFKSLCREEAETPAANLLLLLSWKPQRWLQLQRAGLRLGL

SEQ ID NO: 870152 - protein, 709 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRYEEEEEEEEDEEEMEEEKGVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPAQEEEAPVSPHKKPAPQKRRRAKKARLLGPTVMLGGCEFSRQRLQAFGLNPKRLHFRQLGRQRRKQQGPKNSS

SEQ ID NO: 870153 - protein, 737 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRYEEEEEEEEDEEEMEEEKGVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGEAQVGRPWVGRGHRGAWHEPSSLALSRGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPAQEEEAPVSPHKKPAPQKRRRAKKARLLGPTVMLGGCEFSRQRLQAFGLNPKRLHFRQLGRQRRKQQGPKNSS

SEQ ID NO: 870154 - protein, 738 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKGYWGLTGLLGDRVAGGWASADAQCYAFPQAQEEADYIEWLKGQKEIRNPDSLKELTHLKEYWNDPELDEGERFLRDYILNKRYEEEEEEEEDEEEMEEEKGVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPAQEEEAPVSPHKKPAPQKRRRAKKARLLGPTVMLGGCEFSRQRLQAFGLNPKRLHFRQLGRQRRKQQGPKNSS

SEQ ID NO: 870155 - protein, 658 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRYEEEEEEEEDEEEMEEEKGVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPALWEAEVKGSLEPRNWRPAWAT

SEQ ID NO: 870156 - protein, 448 aa, Homo sapiens
MARWRLGVNRPRVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPAQEEEAPVSPHKKPAPQKRRRAKKARLLGPTVMLGGCEFSRQRLQAFGLNPKRLHFRQLGRQRRKQQGPKNSS

SEQ ID NO: 870157 - protein, 493 aa, Homo sapiens
SRLPSDSRRHRRKVMWRNRNSSRKASGHLWRTVRTRTALGRAAPVCCRNVPKPGRRRVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPAQEEEAPVSPHKKPAPQKRRRAKKARLLGPTVMLGGCEFSRQRLQAFGLNPKRLHFRQLGRQRRKQQGPKNSS

SEQ ID NO: 870158 - protein, 548 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKERVHGPPVQLAVDDSSDEGELFLKKQEDFEQKYNFRFEEPDSASVKTYPRSIASSVRRKDERRKEKREETRERKKRKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPAQEEEAPVSPHKKPAPQKRRRAKKARLLGPTVMLGGCEFSRQRLQAFGLNPKRLHFRQLGRQRRKQQGPKNSS

SEQ ID NO: 870159 - protein, 417 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKGYWGLTGLLGDRVAGGWASADAQCYAFPQAQEEADYIEWLKGQKEIRNPDSLKELTHLKEYWNDPELDEGERFLRDYILNKRYEEEEEEEEDEEEMEEEKGVHGPPVQLAVDDSSDEGELFLKKQEDFEQKYNFRFEEPDSASVKTYPRSIASSVRRKDERRKEKREETRERKKRRKTKNDRKSIKQMKNTKRQGEYLRPKTEKKTDRKENRANGE

SEQ ID NO: 870160 - protein, 204 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDRETSNHRLQGTRRSRSTWMSITGWTTRTSSTTCPVASSTAQWCPVTLASALRRSSLLTIRS

SEQ ID NO: 870161 - protein, 709 aa, Homo sapiens; identical to SEQ ID NO: 870152

SEQ ID NO: 870162 - protein, 613 aa, Homo sapiens
IRLGGGWVGIGRALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRYEEEEEEEEDEEEMEEEKGVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPAQEEEAPVSPHKKPAPQKRRRAKKARLLGPTVMLGGCEFSRQRLQAFGLNPKRLHFRQLGRQRRKQQGPKNSS

SEQ ID NO: 870163 - protein, 709 aa, Homo sapiens; identical to SEQ ID NO: 870152

SEQ ID NO: 870164 - protein, 629 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRYEEEEEEEEDEEEMEEEKGVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPGEATVNPQATVNPQATVNPQATVNP

SEQ ID NO: 870165 - protein, 341 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDRETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDFYKTLSLLKKKDPRIYQKDATFYNRTASSSDSEEDPEALEKQKKVRPMYLKDYERKVILEKAGKYVDEENSDGETSNHRLQETSSQSYVEEPD

SEQ ID NO: 870166 - protein, 68 aa, Homo sapiens
SLNYCLLRRKNLTKGHKAEEETEASFRTGVEVHYKALEQKQKEGKCTWKRPSGQLERQVPHPASDVGF

SEQ ID NO: 870167 - protein, 349 aa, Homo sapiens
MAHQTGIHATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMKLDLERETIELVHTEPTDVAQLPSRVPRDAARYHFFLYKHTHEGDPLESVVFIYSMPGYKCSIKERMLYSSCKSRLLDSVEQDFHLEIAKKIEIGDGAELTAEFLYDEVHPKQHAFKQAFAKPKGPGGKRGHKRLIRGPGENGDDS

SEQ ID NO: 870168 - protein, 235 aa, Homo sapiens
YLRLGTRLGVESDDLSFAGYQKHLSSCAAPAPLTSAERELQQIRINEVKTEISVESKHQTLQGLAFPLQPEAQRALQQLKQKMVNYIQMKLDLERETIELVHTEPTDVAQLPSRVPRDAARYHFFLYKHTHEGDPLESVVFIYSMPGYKCSIKERMLYSSCKSRLLDSVEQDFHLEIAKKIEIGDGAELTAEFLYDEVHPKQHAFKQAFAKPKGPGGKRGHKRLIRGPGENGDDS

SEQ ID NO: 870169 - protein, 344 aa, Homo sapiens
SSLDPPGPRRRLRARAAPSPRLPAAPVGGGAPLGAGPAAPPGKLREGRQPPPHPPPLLVQRALPGQGQAEGSDGADGAKRRAMAHQTGIHATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMKLDLERETIELVHTEPTDVAQLPSRVPRDAAGTPFRLRDPCGGPFVCVCPIQPGPLRPT

SEQ ID NO: 870170 - protein, 249 aa, Homo sapiens
CPVARHTGCRTRRRTEPMRGAEPRVADQTGIQATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMTLPGWLKGAGSGAWHEPGLPGS

SEQ ID NO: 870171 - protein, 104 aa, Homo sapiens
MLYSSCKSRLLDSVEQDFHLEIAKKVGALPRASPPQALSLQSPCGALGSWDDGRAGIVAVVLIIGHLRPKEQHAWPKAAQLIGGSEKSKSWLPCHVLSLGLETG

SEQ ID NO: 870172 - protein, 431 aa, Homo sapiens
SSLDPPGPRRRLRARAAPSPRLPAAPVGGGAPLGAGPAAPPGKLREGRQPPPHPPPLLVQRALPGQGQAEGSDGADGAKRRAMAHQTGIHATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMKLDLERETIELVHTEPTDVAQLPSRVPRDAARYHFFLYKHTHEGDPLESVVFIYSMPGYKCSIKERMLYSSCKSRLLDSVEQDFHLEIAKKIEIGDGAELTAEFLYDEVHPKQHAFKQAFAKPKGPGGKRGHKRLIRGPGENGDDS

SEQ ID NO: 870173 - protein, 262 aa, Homo sapiens
MAHQTGIHATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMKLDLERETIELVHTEPTDVAQLPSRVPRDAAGTPFRLRDPCGGPFVCVCPIQPGPLRPT

SEQ ID NO: 870174 - protein, 431 aa, Homo sapiens; identical to SEQ ID NO: 870172

SEQ ID NO: 870175 - protein, 307 aa, Homo sapiens
SSLDPPGPRRRLRARAAPSPRLPAAPVGGGAPLGAGPAAPPGKLREGRQPPPHPPPLLVQRALPGQGQAEGSDGADGAKRRAMAHQTGIHATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMTLPGWLKGAGSGAWHEPGLPGS

SEQ ID NO: 870176 - protein, 218 aa, Homo sapiens
SSLDPPGPRRRLRARAAPSPRLPAAPVGGGAPLGAGPAAPPGKLREGRQPPPHPPPLLVQRALPGQGQAEGSDGADGAKRRAMAHQTGIHATEELKEFFAKARAGSVRLIKVVIEDEQLVLGASQEPVGRWDQDYDRAVLPLLDAQQPCYLLYRLDSQNAQGFEWLFLAWSPDNSPGAVLVMSAWFLLAPLLCVTCWNSMAVLDGGPLVHGLSSSGLF

SEQ ID NO: 870177 - protein, 120 aa, Homo sapiens
LVEGFALLNGRNSSPSPLHARYNQPSGCAAFGITQDLGMGTHPCLHCLVCWLPCSLVLFLHVCFCKLPQCPPSSAVVLLCVPWSPVRRGDTSPRRRCRCRRAAASSAPAAAFPAPWSSPR

SEQ ID NO: 870178 - protein, 95 aa, Homo sapiens
DGRGGPRTLHGCRGTARRAGSGRIHPPPPGGRPRLELESVDPGAGKGGVCRPWGSGDPSPRDGSCSLSGAQWGWGQRKVPVARTCSIDWSGGGLG

SEQ ID NO: 870179 - protein, 179 aa, Homo sapiens
PCTEWINLTSTFLRKNQCETRTKWLLITRCGWDWPCWGCWATCRQHRRPRSPCSPTSSRTSSWGAGSARASPPTRAGSGRRRRRCPCASPSAPTATGVPDWGSTYSVSVVETDYDQYALLYSQGSKGPGEDFRMATLYSRTQTPRAELKEKFTAFCKAQGFTEDTIVFLPQTDKCMTEQ

SEQ ID NO: 870180 - protein, 228 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGPWRGLPHGHPLQPNPDPQG

SEQ ID NO: 870181 - protein, 180 aa, Homo sapiens
GWYRSECMDPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGPWRGLPHGHPLQPNPDPQG

SEQ ID NO: 870182 - protein, 214 aa, Homo sapiens
RGCEGRGHLLGRGCEGRGQLLGRRCEGRGHLLGRGLRGGGQFLGRGVRGVAARGIGRGGGAGLETGGVDGRGAPAGRRRWVRRVLADAGGGRSPQFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGPWRGLPHGHPLQPNPDPQG

SEQ ID NO: 870183 - protein, 157 aa, Homo sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGPWRGLPHGHPLQPNPDPQG

SEQ ID NO: 870184 - protein, 228 aa, Homo sapiens; identical to SEQ ID NO: 870180

SEQ ID NO: 870185 - protein, 228 aa, Homo sapiens; identical to SEQ ID NO: 870180

SEQ ID NO: 870186 - protein, 190 aa, Homo sapiens
RQRSHSASSSPSPSRVTSRTTPRRQGSVSPCSNVESRLLPRYSHSGGSSCTPPSLSHTTGTRPRTPALLQEFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGPWRGLPHGHPLQPNPDPQG

SEQ ID NO: 870187 - protein, 228 aa, Homo sapiens; identical to SEQ ID NO: 870180

SEQ ID NO: 870188 - protein, 228 aa, Homo sapiens; identical to SEQ ID NO: 870180

SEQ ID NO: 870189 - protein, 302 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGPWRGLPHGHPLQVRAPWTPPTRRPDQRGLPKTQGRAHSIPPAEASSVSTLSQGRTQTPRAELKEKFTAFCKAQGFTEDTIVFLPQTDKCMTEQ

SEQ ID NO: 870190 - protein, 445 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGGDGCPTSVRGKGQAWAVTTHAQVLGTERPFLQGVGSSLEPTIVLSGPFPALWSFPHISSPPRPLHMPPPNSPPQDPGVSSLPPGEWLPRGNLFTSGSGSDFCGCTRNPGFLSLAPPDSGLGTGFTGCAGESRALAGEQPGGGASRASRGAECPQSPQVHPFPEAEVRFGGLSPRQGCLLGSQTGAAPTPCQWWRPTTTSTRCCTARAARALARTSAWPPSTAEPRPPGLS

SEQ ID NO: 870191 - protein, 284 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGGPLGGREKGGKPFFPLGNWGPPNPPVLNSRKPQDRRTQTPRAELKEKFTAFCKAQGFTEDTIVFLPQTDKCMTEQ

SEQ ID NO: 870192 - protein, 431 aa, Homo sapiens
RGCEGRGHLLGRGCEGRGQLLGRRCEGRGHLLGRGLRGGGQFLGRGVRGVAARGIGRGGGAGLETGGVDGRGAPAGRRRWVRRVLADAGGGRSPQFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGGDGCPTSVRGKGQAWAVTTHAQVLGTERPFLQGVGSSLEPTIVLSGPFPALWSFPHISSPPRPLHMPPPNSPPQDPGVSSLPPGEWLPRGNLFTSGSGSDFCGCTRNPGFLSLAPPDSGLGTGFTGCAGESRALAGEQPGGGASRASRGAECPQSPQVHPFPEAEVRFGGLSPRQGCLLGSQTGAAPTPCQWWRPTTTSTRCCTARAARALARTSAWPPSTAEPRPPGLS

SEQ ID NO: 870193 - protein, 236 aa, Homo sapiens
RQRSHSASSSPSPSRVTSRTTPRRQGSVSPCSNVESRLLPRYSHSGGSSCTPPSLSHTTGTRPRTPALLQENGYSSHAVDGTGPAGGAGRPAGSTGGPGLRAAQLPAGQVPGALVQRGPRLQLELAPGEEGGVVHVQVCGGPCHGWWPQPDLHLPQDWGSTYSVSVVETDYDQYALLYSQGSKGPGEDFRMATLYSRTQTPRAELKEKFTAFCKAQGFTEDTIVFLPQTDKCMTEQ

SEQ ID NO: 870194 - protein, 218 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPRLGQHLLRVSGGDRLDEFRHHHDDSARRRRFRTTTIP

SEQ ID NO: 870195 - protein, 194 aa, Homo sapiens
RQRSHSASSSPSPSRVTSRTTPRRQGSVSPCSNVESRLLPRYSHSGGSSCTPPSLSHTTGTRPRTPALLQENGYSSHAVDGTGPAGGAGRPAGSTGGPGLRAAQLPAGQVPGALVQRGPRLQLELAPGDDQYALLYSQGSKGPGEDFRMATLYSRTQTPRAELKEKFTAFCKAQGFTEDTIVFLPQTDKCMTEQ

SEQ ID NO: 870196 - protein, 232 aa, Homo sapiens
RQRSHSASSSPSPSRVTSRTTPRRKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKTSVKTRTMLLDALSVGREGGREAGASRTYREMLYSRGTLEMARPRRRTKGKKKFAAEARKVRAAGEQVEKRDSCE

SEQ ID NO: 870197 - protein, 230 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKDWGSTYSVSVVETDYDQYALLYSQGSKGPGEDFRMATLYKYVPLWTPPTRRPDQRGLPKTQGRAHSIPPAEASSVSTLSQGRTQTPRAELKEKFTAFCKAQGFTEDTIVFLPQTDKCMTEQ

SEQ ID NO: 870198 - protein, 247 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKVRGFPASSPRATGPCQGKGTFRLGLPPGRSERSPAVPGSAGQGLSGRAGRRLGSRPRRLPARSPPWAPRPVSPDGPRRHRATHAPTPARHVHPCGHATPRGHTSARSTPGCQDTGGWGTGMATNTPCAVGVGRDAHRT

SEQ ID NO: 870199 - protein, 134 aa, Homo sapiens
RQRSHSASSSPSPSRVTSRTTPRRQGSVSPCSNVESRLLPRYSHSGGSSCTPPSLSHTTGTRPRTPALLQENGYSSHAVDGTGPAGGAGRPAGSTGGPKRPDNPATDQYRLPKSRDDNQRYRQATQSTKRDDLK

SEQ ID NO: 870200 - protein, 157 aa, Homo sapiens; identical to SEQ ID NO: 870183

SEQ ID NO: 870201 - protein, 228 aa, Homo sapiens; identical to SEQ ID NO: 870180

SEQ ID NO: 870202 - protein, 214 aa, Homo sapiens; identical to SEQ ID NO: 870182

SEQ ID NO: 870203 - protein, 190 aa, Homo sapiens
SWYGRGWMAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGPWRGLPHGHPLQPNPDPQG

SEQ ID NO: 870204 - protein, 228 aa, Homo sapiens; identical to SEQ ID NO: 870180

SEQ ID NO: 870205 - protein, 228 aa, Homo sapiens; identical to SEQ ID NO: 870180

SEQ ID NO: 870206 - protein, 228 aa, Homo sapiens; identical to SEQ ID NO: 870180

SEQ ID NO: 870207 - protein, 445 aa, Homo sapiens; identical to SEQ ID NO: 870190

SEQ ID NO: 870208 - protein, 262 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGGLGQHLLRVSGGDRLRPVRAAVQPGQQGPWRGLPHGHPLQPNPDPQG

SEQ ID NO: 870209 - protein, 221 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGPWRGLPHGHPLQ

SEQ ID NO: 870210 - protein, 234 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPRLGQHLLRVSGGDRLRPVRAAVQPGQQGPWRGLPHGHPLHIRSPIRSSGQRSS

SEQ ID NO: 870211 - protein, 231 aa, Homo sapiens
DKEAILRPLLQVLVGCRREQLHGDKDQYLPAPMWNPDCCQDTVILAAPPAHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGGDGCPTSVRGKGQAWA

SEQ ID NO: 870212 - protein, 231 aa, Homo sapiens; identical to SEQ ID NO: 870211

SEQ ID NO: 870213 - protein, 190 aa, Homo sapiens; identical to SEQ ID NO: 870186

SEQ ID NO: 870214 - protein, 136 aa, Homo sapiens
MAAVPNGSRSQCGPHALVALAGLVTGIPTHHPRVYNIHSRTVTRYPANSIVVVGGCPVCRVGVLEDCFTFLGIFLAIILFRIGPAAIGQWQPPNGSRTQTPRAELKEKFTAFCKAQGFTEDTIVFLPQTDKCMTEQ

SEQ ID NO: 870215 - protein, 140 aa, Homo sapiens
GVSVQVRTSLPQPLHEEPPPWGTWRPGAHSVPGPSSSQDVGLQPGGGHRVEGAHGGYRGTNHTGLRHSLLGVDSLLLAEVEKDPLFVSSAQGEVGGDGGSVQFGGSVKTSSALREEQEAQWENWPKSGVLTTAPGFFLGR

SEQ ID NO: 870216 - protein, 145 aa, Homo sapiens
MGACMYMQQVSLKIQVSEGHLCHSTVKNLKLNMTFQFIKILWPIWPLEFLPGLTSLQVPVTCQSAQSPLPPPPSTLHVHPPCSNFPQVLMLNRLAINQTVFVLPVFSGYISPLFSYIIYILQYLFFKVPVGIEQVKGGLTLVPEY

SEQ ID NO: 870217 - protein, 141 aa, Homo sapiens
MSFSLNFTLPANTTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 870218 - protein, 223 aa, Homo sapiens
KGARAPERGGSGGLALPEGQSQGHAGARDSAFRAARRLSASVPRPGAAGGMIRHAGAPARGDPTGPVPVVGKGEEEEEEDGMRLCLPANPKNCLPHRRGISILEKLIKTCPVWLQLSLGQAEVARILHRVVAGMFLVRRDSSSKQLVLCVHFPSLNESSAEVLEYTIKEEKSILYLEGSALVFEDIFRLIAFYCVSRDLLPFTLRLPQAILEASSFTGHSHRR

SEQ ID NO: 870219 - protein, 981 aa, Homo sapiens
KGARAPERGGSGGLALPEGQSQGHAGARDSAFRAARRLSASVPRPGAAGGMIRHAGAPARGDPTGPVPVVGKGEEEEEEDGMRLCLPANPKNCLPHRRGISILEKLIKTCPVWLQLSLGQAEVARILHRVVAGMFLVRRDSSSKQLVLCVHFPSLNESSAEVLEYTIKEEKSILYLEGSALVFEDIFRLIAFYCVSRDLLPFTLRLPQAILEASSFTDLETIANLGLGFWDSSLNPPQERGKPAEPPRDRAPGFPLVSSLRPTAHDANCACEIELSVGNDRLWFVNPIFIEDCSSALPTDQPPLGNCPARPLPPPLMPPHPPPGPPDHPNQPPMMTCERLPCPTAGLGPLREEAMKPGAASSPLQQVPAPPLPAKKNLPTAPPRRRVSERVSLEDQSPGMAAEGDQLSLPPQGTSDGPEDTPRESTEQGQDTEVKASDPHSMPELPRTAKQPPVPPPRKKRISRQLASTLPAPLENAELCTQAMALETPTPGPPREGQSPASQAGTQHPPAQATAHSQSSPEFKGSLASLSDSLGVSVMATDQDSYSTSSTEEELEQFSSPSVKKKPSMILGKARHRLSFASFSSMFHAFLSNNRKLYKKVVELAQDKGSYFGSLVQDYKVYSLEMMARQTSSTEMLQEIRTMMTQLKSYLLQSTELKALVDPALHSEEELEAIVESALYKCVLKPLKEAINSCLHQIHSKDGSLQQLKENQLVILATTTTDLGVTTSVPEVPMMEKILQKFTSMHKAYSPEKKISILLKTCKLIYDSMALGNPGKPYGADDFLPVLMYVLARSNLTEMLLNVEYMMELMDPALQLGEGSYYLTTTYGALEHIKSYDKITVTRQLSVEVQDSIHRWERRRTLNKARASRSSVQDFICVSYLEPEQQARTLASRADTQAQALCAQCAEKFAVERPQAHRLFVLVDGRCFQLADDALPHCIKGYLLRSEPKRDFHFVYRPLDGGGGGGGGSPPCLVVREPNFL

SEQ ID NO: 870220 - protein, 786 aa, Homo sapiens
KGARAPERGGSGGLALPEGQSQGHAGARDSAFRAARRLSASVPRPGAAGGMIRHAGAPARGDPTGPVPVVGKGEEEEEEDGMRLCLPANPKNCLPHRRGISILEKLIKTCPVWLQLSLGQAEVARILHRVVAGMFLVRRDSSSKQLVLCVHFPSLNESSAEVLEYTIKEEKSILYLEGSALVFEDIFRLIAFYCVSRDLLPFTLRLPQAILEASSFTDLETIANLGLGFWDSSLNPPQERGKPAEPPRDRAPGFPLVSSLRPTAHDANCACEIELSVGNDRLWFVNPIFIEDCSSALPTDQPPLGNCPARPLPPPLMPPHPPPGPPDHPNQPPMMTCERLPCPTAGLGPLREEAMKPGAASSPLQQVPAPPLPAKKNLPTAPPRRRVSERVSLEDQSPGMAAEGDQLSLPPQGTSDGPEDTPRESTEQGQDTEVKASDPHSMPELPRTAKQPPVPPPRKKRISRQLASTLPAPLENAELCTQAMALETPTPGPPREGQSPASQAGTQHPPAQATAHSQSSPEFKGSLASLSDSLGVSVMATDQDSYSTSSTEEELEQFSSPSVKKKPSMILGKARHRLSFASFSSMFHAFLSNNRKLYKKVVELAQDKGSYFGSLVQDYKVYSLEMMARQTSSTEMLQEIRTMMTQLKSYLLQSTELKALVDPALHSEEELEAIVESALYKCVLKPLKEAINSCLHQIHSKDGSLQQLKENQLVILATTTTDLGVTTSVPEVPMMEKILQKFTSMHKAYSPEKKISILLKTCKLIYDSMALGNPATSRRCFSMWST

SEQ ID NO: 870221 - protein, 361 aa, Homo sapiens
MGGGRYPHFTAGARRIKATQAVGAKAKPGRCGAGSLGVEDGGRAPCSCCECPAPARRRRLALPALLMPGLPHRLRPASFTRSPPALPIPAPRSSSEPQGSCSPKGLDCVARPHYGMPGRARTSFLSVLPSVPSIAPGVQGTHLEGGREGMNEGMNDGEPVDQQPGDAPAPLCRDSETRLNSSPRTVGPAGKPGREGDGPPAGSRQRRERRRCRTRRQLGARHPLSIQGGAWAGRGRLRRQGPAVTTGPSRLLQDFICVSYLEPEQQARTLASRADTQAQALCAQCAEKFAVERPQAHRLFVLVDGRCFQLADDALPHCIKGYLLRSEPKRDFHFVYRPLDGGGGGGGGSPPCLVVREPNFL

SEQ ID NO: 870222 - protein, 192 aa, Homo sapiens
KGARAPERGGSGGLALPEGQSQGHAGARDSAFRAARRLSASVPRPGAAGGMIRHAGAPARGDPTGPVPVVGKGEEEEEEDGMRLCLPANPKNCLPHRRGISILEKLIKTCPVWLQLSLGQAEVARILHRVVAGMFLVRRDSSSKQLVLCVHFPSLNESSAEVLEYTIKEEKSTFPFSASNTGVGPGKKYIMR

SEQ ID NO: 870223 - protein, 125 aa, Homo sapiens
CLSPRAQFVRCNREDADHQFSAEFVKGSRIPLPMLAFGTLLEQNHCLEREKEKRVSVNMLALGETSMFLVRRDSSSKQLVLCVHFPSLNESSAEVLEYTIKEEKSTFPFSASNTGVGPGKKYIMR

SEQ ID NO: 870224 - protein, 770 aa, Homo sapiens
PSPWHRLTPCPSLASTGFWDSSLNPPQERGKPAEPPRDRAPGFPLVSSLRPTAHDANCACEIELSVGNDRLWFVNPIFIEDCSSALPTDQPPLGNCPARPLPPPLMPPHPPPGPPDHPNQPPMMTCERLPCPTAGLGPLREEAMKPGAASSPLQQVPAPPLPAKKNLPTAPPRRRVSERVSLEDQSPGMAAEGDQLSLPPQGTSDGPEDTPRESTEQGQDTEVKASDPHSMPELPRTAKQPPVPPPRKKRISRQLASTLPAPLENAELCTQAMALETPTPGPPREGQSPASQAGTQHPPAQATAHSQSSPEFKGSLASLSDSLGVSVMATDQDSYSTSSTEEELEQFSSPSVKKKPSMILGKARHRLSFASFSSMFHAFLSNNRKLYKKVVELAQDKGSYFGSLVQDYKVYSLEMMARQTSSTEMLQEIRTMMTQLKSYLLQSTELKALVDPALHSEEELEAIVESALYKCVLKPLKEAINSCLHQIHSKDGSLQQLKENQLVILATTTTDLGVTTSVPEVPMMEKILQKFTSMHKAYSPEKKISILLKTCKLIYDSMALGNPGKPYGADDFLPVLMYVLARSNLTEMLLNVEYMMELMDPALQLGEGSYYLTTTYGALEHIKSYDKITVTRQLSVEVQDSIHRWERRRTLNKARASRSSVQDFICVSYLEPEQQARTLASRADTQAQALCAQCAEKFAVERPQAHRLFVLVDGRCFQLADDALPHCIKGYLLRSEPKRDFHFVYRPLDGGGGGGGGSPPCLVVREPNFL

SEQ ID NO: 870225 - protein, 757 aa, Homo sapiens
KGARAPERGGSGGLALPEGQSQGHAGARDSAFRAARRLSASVPRPGAAGGMIRHAGAPARGDPTGPVPVVGKGEEEEEEDGMRLCLPANPKNCLPHRRGISILEKLIKTCPVWLQLSLGQAEVARILHRVVAGMFLVRRDSSSKQLVLCVHFPSLNESSAEVLEYTIKEEKSILYLEGSALVFEDIFRLIAFYCVSRDLLPFTLRLPQAILEASSFTDLETIANLGLGFWDSSLNPPQERGKPAEPPRDRAPGFPLVSSLRPTAHDANCACEIELSVGNDRLWFVNPIFIEDCSSALPTDQPPLGNCPARPLPPPLMPPHPPPGPPDHPNQPPMMTCERLPCPTAGLGPLREEAMKPGAASSPLQQVPAPPLPAKKNLPTAPPRRRVSERVSLEDQSPGMAAEGDQLSLPPQGTSDGPEDTPRESTEQGQDTEVKASDPHSMPELPRTAKQPPVPPPRKKRISRQLASTLPAPLENAELCTQAMALETPTPGPPREGQSPASQAGTQHPPAQATWPNFPQEASPGSFKGASPWAYPSSKNQLWRGWSCSWATRTKGTSYDSKPGKAREGTELEASFRQAPQAGETQQKPPPMILGPRARATRLEPLARFPRQASVPQLFRPPNNRQGCYKKGWVEPWAARDKGALGTFCGEAWVPVTYPGMYKPWKMNWPAAHEPIPSHWGGNCFGKGSEFSAPSRWNRQAFQESLTKSVHENNAETLYRAPGRVNPAALGTSRSERELRKADCVRGPCLGTPKWYP

SEQ ID NO: 870226 - protein, 154 aa, Homo sapiens
KPYGADDFLPVLMYVLARSNLTEMLLNVEYMMELMDPALQLGEGESPPPAHQVHCTPPTQPRHGHSRWPNKHLLDARLWLSSGPMDANVNPTQVLSCRSSQIRGRDEPVKRLCHLHVTSAGIVGIPEGIGACYPDCAVREGFLEEVTSELSNEG

SEQ ID NO: 870227 - protein, 119 aa, Homo sapiens
SLIKLIPPPPEEEMAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQGL

SEQ ID NO: 870228 - protein, 219 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKYNLRITSGVVVCQCGLSIPSHSSELTEQKLRACLEGSINEHSAHCPHTPEFSVTGGTEEKSSLLMSCLACDTWAVIL

SEQ ID NO: 870229 - protein, 219 aa, Homo sapiens; identical to SEQ ID NO: 870228

SEQ ID NO: 870230 - protein, 142 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTK

SEQ ID NO: 870231 - protein, 126 aa, Homo sapiens [sequence omitted]

SEQ ID NO: 870232 - protein, 172 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKYNLRITSGVVVCQCGLSIPSHACDTWAVIL

SEQ ID NO: 870233 - protein, 172 aa, Homo sapiens; identical to SEQ ID NO: 870232

SEQ ID NO: 870234 - protein, 148 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKPVILGL

SEQ ID NO: 870235 - protein, 142 aa, Homo sapiens; identical to SEQ ID NO: 870230

SEQ ID NO: 870236 - protein, 132 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEVTPSSSPSLPVFSYWNTVTFPPIRISL

SEQ ID NO: 870237 - protein, 106 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQGL

SEQ ID NO: 870238 - protein, 145 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTNLLS

SEQ ID NO: 870239 - protein, 235 aa, Homo sapiens
MPKSVSTWGRSIKQHFPEYAAIHSRSAPGKYTSQGSVRASRERVLWLCLPRRGDGGVVEVSAPLPVQTGGLAALERGFPAEMPGENEKQPGQAPKQVPPGWKQWAREFSEQLSSSRGDGRRVECFAVSGELSRRLGSAGGADRHGCAGGNSTGADQPRYNLRITSGVVVCQCGLSIPSHSSELTEQKLRACLEGSINEHSAHCPHTPEFSVTGGTEEKSSLLMSCLACDTWAVIL

SEQ ID NO: 870240 - protein, 176 aa, Homo sapiens
MAESLRSPRRSLYKLVGSPPWKEAFRQRCLERMRNSRDRLLNRYRQAGSSGPGNSQNSFLVQEVCFAVSGELSRRLGSAGGADRHGCAGGNSTGADQPRYNLRITSGVVVCQCGLSIPSHSSELTEQKLRACLEGSINEHSAHCPHTPEFSVTGGTEEKSSLLMSCLACDTWAVIL

SEQ ID NO: 870241 - protein, 148 aa, Homo sapiens; identical to SEQ ID NO: 870234

SEQ ID NO: 870242 - protein, 142 aa, Homo sapiens; identical to SEQ ID NO: 870230

SEQ ID NO: 870243 - protein, 537 aa, Homo sapiens
KLHTSHYNPANLKHLPLQLVQMALSQSVPFSATELLLASAIFCLVFWVLKGLRPRVPKGLKSPPEPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKNSVRDITGALFKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 870244 - protein, 164 aa, Homo sapiens
ECSELRSHHCTPAWVIGAGGCLKKKKRKNFQSALTLVFSTEVSLPQAPPPRASPALRSHLLCSSCRELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 870245 - protein, 273 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 870246 - protein, 245 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKGKAKNPPGDSSLHWAAMALPALFSLIIGFAFGALYWKKRQPSLTRAVENIQINEEDNEISMLQEKEREFQEV

SEQ ID NO: 870247 - protein, 205 aa, Homo sapiens
TTTKFAAAWTLPSLMSCLYVYTDTYEMHIGMLGMCICIYRERNVLTTWKDYLKTNEVFPLPYSNKKVGSPFNFAIFCYYIYRKAAFYNAEIMVYLRISDQEQISIFSYCFSVCCKRKRESFKKCKLWLVSTLLLSYIGKFFSSFLFFSFFYYTLSSRVHVHNVQVCYVCLHVPCWCAAPINSSFTLGISPNAIPCRRGREFSSSR

SEQ ID NO: 870248 - protein, 245 aa, Homo sapiens; identical to SEQ ID NO: 870246

SEQ ID NO: 870249 - protein, 675 aa, Homo sapiens
EEEGTRRRGLAASLRADFSPMVQRDMSKSPPTAAAAVAQEIQMELLENVAPAGALGAAAQSYGKGARRKNRFKGSDGSTSSDTTSNGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 870250 - protein, 605 aa, Homo sapiens
MQCCGLVHRRRVRVSYGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 870251 - protein, 605 aa, Homo sapiens; identical to SEQ ID NO: 870250

SEQ ID NO: 870252 - protein, 372 aa, Homo sapiens [sequence omitted]

SEQ ID NO: 870253 - protein, 128 aa, Homo sapiens
MLDRRLIAPQTKYIIPGGSADSYTSRPSDSDVSLEEDREAVRREAERQAQAQLEKAKTKPVAFAVRTNVSYSAAHEDDVPVPGMAISFEAKDFLHVKEVRRIISFSNSMMFHLDIPFLISYSYAVSVK

SEQ ID NO: 870254 - protein, 606 aa, Homo sapiens
MLDRRLIAPQTKYIIPGGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 870255 - protein, 104 aa, Homo sapiens
LILIISHLTNKHVHKTTKIPLDISLISYCMIWSENKKQNKNETSVLSSFCLLLSPAKQSPKLVYFSVVSCSVHFSIHYNVFSHHSLKLLAPRSSGLLAAKTIIL

SEQ ID NO: 870256 - protein, 919 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 870257 - protein, 923 aa, Homo sapiens
MIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 870258 - protein, 903 aa, Homo sapiens
MIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 870259 - protein, 639 aa, Homo sapiens [sequence omitted]

SEQ ID NO: 870260 - protein, 919 aa, Homo sapiens; identical to SEQ ID NO: 870256

SEQ ID NO: 870261 - protein, 919 aa, Homo sapiens; identical to SEQ ID NO: 870256

SEQ ID NO: 870262 - protein, 888 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILGLALGEEWTAAG

SEQ ID NO: 870263 - protein, 424 aa, Homo sapiens
ASRAGCNRPRQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 870264 - protein, 726 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTFCGSILLWMDPQLRALE

SEQ ID NO: 870265 - protein, 697 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIFGTICESC

SEQ ID NO: 870266 - protein, 452 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLHKTTSGSRMM

SEQ ID NO: 870267 - protein, 903 aa, Homo sapiens; identical to SEQ ID NO: 870258

SEQ ID NO: 870268 - protein, 238 aa, Homo sapiens
KAGFAAGPGVRGATGRPAAGRGGAQESEAGADQHGLAEPARRTVTGPLTSSSLPSPPALSPSLPPSRSLLLTPGAGSRLAPLPREQLLFSRGARGAPASPAAETPQPGGGLSGALDGQPEQDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQ

SEQ ID NO: 870269 - protein, 919 aa, Homo sapiens; identical to SEQ ID NO: 870256

SEQ ID NO: 870270 - protein, 919 aa, Homo sapiens; identical to SEQ ID NO: 870256

SEQ ID NO: 870271 - protein, 949 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEVWLWERSGQQLVEIHPHLETGLPLTEDVSCV

SEQ ID NO: 870272 - protein, 186 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEVNLGSDCNK

SEQ ID NO: 870273 - protein, 34 aa, Homo sapiens
MKASVKEIRRKQSHNSIHKRGQTLTTARSTWATC

SEQ ID NO: 870274 - protein, 101 aa, Homo sapiens
KQAHLGTDSKQGSEERASPLRSGPPGEVAVSFPDARSKQRLMLETSDARGRIPVARGNYLEVIYPCTALWGWVFLAHCMSWYYSKSDRYMFSHAFHVLDTF

SEQ ID NO: 870275 - protein, 45 aa, Homo sapiens
PLCFLTNPGTSPKGPVWCGCLLLLGTDQQGPISQDWKNTPKVSVM

SEQ ID NO: 870276 - protein, 269 aa, Homo sapiens
SNSLPPSRPGQRRPPPPLGRGLQTALPDSQDDQGASLFLSGEEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEVSCQLRLEFRNLQPQWRD

SEQ ID NO: 870277 - protein, 162 aa, Homo sapiens
VVAEAVKRIPPADTTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRECNNMEIQVDIATCG

SEQ ID NO: 870278 - protein, 528 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870279 - protein, 528 aa, Homo sapiens; identical to SEQ ID NO: 870278

SEQ ID NO: 870280 - protein, 528 aa, Homo sapiens; identical to SEQ ID NO: 870278

SEQ ID NO: 870281 - protein, 440 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQEKG

SEQ ID NO: 870282 - protein, 528 aa, Homo sapiens; identical to SEQ ID NO: 870278

SEQ ID NO: 870283 - protein, 528 aa, Homo sapiens; identical to SEQ ID NO: 870278

SEQ ID NO: 870284 - protein, 440 aa, Homo sapiens; identical to SEQ ID NO: 870281

SEQ ID NO: 870285 - protein, 412 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEIPMSAYSEAWHWGPGPAPGLLEFPLIQLGWDTP

SEQ ID NO: 870286 - protein, 545 aa, Homo sapiens
MKTILSNQTVDIPENVDITLKGRTEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870287 - protein, 473 aa, Homo sapiens [sequence omitted]

SEQ ID NO: 870288 - protein, 374 aa, Homo sapiens [sequence omitted]

SEQ ID NO: 870289 - protein, 365 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQTAPGLLEFPLIQLGWDTP

SEQ ID NO: 870290 - protein, 473 aa, Homo sapiens [sequence omitted]

SEQ ID NO: 870291 - protein, 479 aa, Homo sapiens
MGDAPSPEEKLHLITRNLQVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870292 - protein, 315 aa, Homo sapiens
MVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870293 - protein, 384 aa, Homo sapiens
MFMFMCFFPQALDEEYLKVDAQFGGIDQRKIFTFAEKMRTLRIEDKKCPISHKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870294 - protein, 179 aa, Homo sapiens [sequence omitted]

SEQ ID NO: 870295 - protein, 155 aa, Homo sapiens
ESDHSEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870296 - protein, 192 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQVRSSSRCPKGNFPQRHSQSWCN

SEQ ID NO: 870297 - protein, 192 aa, Homo sapiens; identical to SEQ ID NO: 870296

SEQ ID NO: 870298 - protein, 197 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVAAPGLLEFPLIQLGWDTP

SEQ ID NO: 870299 - protein, 192 aa, Homo sapiens; identical to SEQ ID NO: 870296

SEQ ID NO: 870300 - protein, 497 aa, Homo sapiens
MARQQRAQTLRVRTKHTSGLSYGQESGPADDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRFSMIHAVTQQSGFCLHRECNNMEIQVDIEAKPSHYQLVSGSSTEDSLHVHAQMAENEEEGSGGGGSEEDPPCRHQSCEQKDCLASKPWDISLAQPESIRSDLESSDAQSDDVPDITSDECGSPRSHTAACPSTPRAQGAPSPSAHMNLSALAEGQTVLKPEGGEARV

SEQ ID NO: 870301 - protein, 161 aa, Homo sapiens [sequence omitted]

SEQ ID NO: 870302 - protein, 148 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSLGDRQCKTPS

SEQ ID NO: 870303 - protein, 230 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNLWSRITAQILERSDVLSR

SEQ ID NO: 870304 - protein, 89 aa, Homo sapiens
SESRVPISCPECSERLNPHDIRLLLADPPLMHKYEEFMLRRYLASDPDCRWCPAPDCGDAGIAIPAMVIGIPVYVGRREILRNSQFLTR

SEQ ID NO: 870305 - protein, 528 aa, Homo sapiens; identical to SEQ ID NO: 870278

SEQ ID NO: 870306 - protein, 528 aa, Homo sapiens; identical to SEQ ID NO: 870278

SEQ ID NO: 870307 - protein, 528 aa, Homo sapiens; identical to SEQ ID NO: 870278

SEQ ID NO: 870308 - protein, 528 aa, Homo sapiens; identical to SEQ ID NO: 870278

SEQ ID NO: 870309 - protein, 537 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQSAPSITHLPISQDTEAAGLDSLFGAELGKGQLTLPRTQDHPVWLQ

SEQ ID NO: 870310 - protein, 471 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQNPEPRIILSGCSERPTPNKGWATAGSPALPSSLGSWRNLVSI

SEQ ID NO: 870311 - protein, 528 aa, Homo sapiens; identical to SEQ ID NO: 870278

SEQ ID NO: 870312 - protein, 539 aa, Homo sapiens
TIGLGTRPGGCMGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870313 - protein, 548 aa, Homo sapiens
RGLYVVFSWSVRFYNFTSGAMGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870314 - protein, 366 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQTQASGQREWIFRHIKDSKI

SEQ ID NO: 870315 - protein, 509 aa, Homo sapiens
CQYPRLCTRLGGAGRGSGAGLSGGSRGSGAMGDAPSPEEKLHLITRNLQVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870316 - protein, 315 aa, Homo sapiens; identical to SEQ ID NO: 870292

SEQ ID NO: 870317 - protein, 281 aa, Homo sapiens
MWARNSHACELGMLSMSLLTWILFLIEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870318 - protein, 142 aa, Homo sapiens
TLRIPVDYGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 870319 - protein, 246 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEVSCQLRLEFRNLQPQWRD

SEQ ID NO: 870320 - protein, 192 aa, Homo sapiens; identical to SEQ ID NO: 870296

SEQ ID NO: 870321 - protein, 480 aa, Homo sapiens [sequence omitted]

SEQ ID NO: 870322 - protein, 205 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQALDEEYLKVDAQFGGIAQRKIFTFAREGECLLSCLFSLAPQRYAAVFIEL

SEQ ID NO: 870323 - protein, 208 aa, Homo sapiens
TEFCYHCKQIWHPNQTCDMARQQRAQTLRVRTKHTSGLSYGQESGPADDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVQWQMPGEPSRIPALGKAALKA

SEQ ID NO: 870324 - protein, 107 aa, Homo sapiens
MQSSAILPKVFIPRPPSYIPTQTPSLFPSHHCSPGAPARPLCPVHLTTLLTMQTSLSTPCALPRLPCTPCPLGPGASSCSNYGPPARASAPSSVHPMVLGSGGHSGH

SEQ ID NO: 870325 - protein, 499 aa, Homo sapiens
MNDDPSMEENGVERVCPESLLQSREYSSLPLPRHTSSTDGTITSSDPGLEILNMASCDLDRNSLCKKEEDTRSASPTIEAQGTSPAHDNIAFQDSTSKDKTILNLEAKEEPETIEEHKKEHASGDSVVSPLPVTTVKSVNVRQSENTSANEKEVEAEFLRLSLGFKCDWFTLEKRVKLEERSRDLAEENLKKEITNSLKLLESLTPLCEDDNQAQEIIKKLEKSIKFLSQCAARVASRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSSWRILGSKQSEHRPSLPRFISTYSWADAEEEKCELKTKDDSEPSGEETVERTRKPSLSEKKNNPSKWDVSSVYDTIASWATNLKSSIRKANKALWLSIAFIVLFAALMSFLTGQLFQKSVDAAPTQQEDSWTSLEHILWPFTRLRHNGPPPV

SEQ ID NO: 870326 - protein, 499 aa, Homo sapiens; identical to SEQ ID NO: 870325

SEQ ID NO: 870327 - protein, 499 aa, Homo sapiens; identical to SEQ ID NO: 870325

SEQ ID NO: 870328 - protein, 446 aa, Homo sapiens
MASCDLDRNSLCKKEEDTRSASPTIEAQGTSPAHDNIAFQDSTSKDKTILNLEAKEEPETIEEHKKEHASGDSVVSPLPVTTVKSVNVRQSENTSANEKEVEAEFLRLSLGFKCDWFTLEKRVKLEERSRDLAEENLKKEITNSLKLLESLTPLCEDDNQAQEIIKKLEKSIKFLSQCAARVASRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSSWRILGSKQSEHRPSLPRFISTYSWADAEEEKCELKTKDDSEPSGEETVERTRKPSLSEKKNNPSKWDVSSVYDTIASWATNLKSSIRKANKALWLSIAFIVLFAALMSFLTGQLFQKSVDAAPTQQEDSWTSLEHILWPFTRLRHNGPPPV

SEQ ID NO: 870329 - protein, 499 aa, Homo sapiens; identical to SEQ ID NO: 870325

SEQ ID NO: 870330 - protein, 348 aa, Homo sapiens
MNDDPSMEENGVERVCPESLLQSREYSSLPLPRHTSSTDGTITSSDPGLEILNMASCDLDRNSLCKKEEDTRSASPTIEAQGTSPAHDNIAFQDSTSKDKTILNLEAKEEPETIEEHKKEHASGDSVVSPLPVTTVKSVNVRQSENTSANEKEVEAEFLRLSLGFKCDWFTLEKRVKLEERSRDLAEENLKKEITNSLKLLESLTPLCEDDNQAQEIIKKLEKSIKFLSQCAARVASRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSS

SEQ ID NO: 870331 - protein, 499 aa, Homo sapiens; identical to SEQ ID NO: 870325

SEQ ID NO: 870332 - protein, 499 aa, Homo sapiens; identical to SEQ ID NO: 870325

SEQ ID NO: 870333 - protein, 499 aa, Homo sapiens; identical to SEQ ID NO: 870325

SEQ ID NO: 870334 - protein, 499 aa, Homo sapiens; identical to SEQ ID NO: 870325

SEQ ID NO: 870335 - protein, 499 aa, Homo sapiens; identical to SEQ ID NO: 870325

SEQ ID NO: 870336 - protein, 259 aa, Homo sapiens
MLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSSWRILGSKQSEHRPSLPRFISTYSWADAEEEKCELKTKDDSEPSGEETVERTRKPSLSEKKNNPSKWDVSSVYDTIASWATNLKSSIRKANKALWLSIAFIVLFAALMSFLTGQLFQKSVDAAPTQQEDSWTSLEHILWPFTRLRHNGPPPV

SEQ ID NO: 870337 - protein, 328 aa, Homo sapiens
MNDDPSMEENGVERVCPESLLQSREYSSLPLPRHTSSTDGTITSSDPGLEILNMASCDLDRNSLCKKEEDTRSASPTIEAQGTSPAHDNIAFQDSTSKDKTILNLEAKEEPETIEEHKKEHASGDSVVSPLPVTTVKSVNVRQSENTSANEKEVEAEFLRLSLGFKCDWFTLEKRVKLEERSRDLAEENLKKEITNSLKLLESLTPLCEDDNQAQEIIKKLEKSIKFLSQCAARVASRAEMLGAINQESRVSKAVEVMIQHVENLKRMYAKEHAELEELKQVLLQNERSFNPLEDDDDCQIKKRSASLNSKVITNSLNKCLANTIRRF

SEQ ID NO: 870338 - protein, 837 aa, Homo sapiens
TRGARLRRLPRAGAGDGHGGRAGGMAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEKPLRNGLVKDKRFLNPSAPPPWTRPHPEYPGHAPRPWPPLHPLQLCSSRAAATSPGTPPPHPASISRPRPPGPLPLRGHRPRPQPTGPGPPRTLRTLWSSPGRKMPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 870339 - protein, 421 aa, Homo sapiens
TRGARLRRLPRAGAGDGHGGRAGGMAAAGPAAGPTGPEPMPSYAQLVQRGWGSALAAARGCTDCGWGLARRGLAEHAHLAPPELLLLALGALGWTALRSAATARLFRVSVAGGRDEGTPDWGKPGPGTWGRRRVPFFQRWLLRMKGSPDVGGGLGLERPRTLEPQDKPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAE

SEQ ID NO: 870340 - protein, 361 aa, Homo sapiens
TRGARLRRLPRAGAGDGHGGRAGGMAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAE

SEQ ID NO: 870341 - protein, 274 aa, Homo sapiens
SEPPGRARGRTEQRHPERGVTWLGRIPSFSPGDSYWSVMHLSGLGHGKTNGILWLKPLGPCRRRCISPFNSALGVLGSAAIGAHIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAE

SEQ ID NO: 870342 - protein, 387 aa, Homo sapiens
TRGARLRRLPRAGAGDGHGGRAGGMAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEEAVAQSSVTFFGTGGARCRHLTHPGL

SEQ ID NO: 870343 - protein, 361 aa, Homo sapiens; identical to SEQ ID NO: 870340

SEQ ID NO: 870344 - protein, 924 aa, Homo sapiens
TRGARLRRLPRAGAGDGHGGRAGGMAAAGPAAGPTGPEPMPSYAQLVQRGWGSALAAARGCTDCGWGLARRGLAEHAHLAPPELLLLALGALGWTALRSAATARLFRVSVAGGRDEGTPDWGKPGPGTWGRRRVPFFQRWLLRMKGRRNVGGGLGLERPRTLEPQDKVSRAAARPLQTVLRGGTGEMRGCGRAGPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEKPLRNGLVKDKRFLNPSAPPPWTRPHPEYPGHAPRPWPPLHPLQLCSSRAAATSPGTPPPHPASISRPRPPGPLPLRGHRPRPQPTGPGPPRTLRTLWSSPGRKMPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPVSAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 870345 - protein, 790 aa, Homo sapiens
TRGARLRRLPRAGAGDGHGGRAGGMAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEKPLRNGLVKDKRFLNPSAPPPWTRPHPEYPGHAPRPWPPLHPLQLCSSRAAATSPGTPPPHPASISRPRPPGPLPLRGHRPRPQPTGPGPPRTLRTLWSSPGRKMPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALAACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 870346 - protein, 361 aa, Homo sapiens; identical to SEQ ID NO: 870340

SEQ ID NO: 870347 - protein, 211 aa, Homo sapiens
MECVLKIIAFGVLNYFRDAWNVFDFVTVLGSITDILVTEIAETNNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLVSPGHCAPPSATSCLGTAQASPTSPADP

SEQ ID NO: 870348 - protein, 1044 aa, Homo sapiens
RRRLRRWGRARSAAVPAAPWLLRSERLARPAPSLPGPLGRGCTRGPGAMVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPGPGPEGGRRHHRRGSPEEAAEREPRRHRAHRHQDPSKECAGAKGERRARHRGGPRAGPREAESGEEPARRHRARHKAQPAHEAVEKEATEKEAEIVEADKEKELRNHQPR

SEQ ID NO: 870349 - protein, 229 aa, Homo sapiens
MMDVDRGHGEEEKKLSLKGGVTRSGYNIVFTSMFSMECVLKIIAFGVLNYFRDAWNVFDFVTVLGSITDILVTEIAETNNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSACTGVFSVWMSLTHRAMQQKTHLIEVKHTRPLPGLGVQHDCDQTFL

SEQ ID NO: 870350 - protein, 141 aa, Homo sapiens
MMDVDRGHGEEEKKLSLKGGVTRSGYNIVFTSMFSMECVLKIIAFGVLNYFRDAWNVFDFVTVLGSITDILVTEIAETNNFINLSFLRLFRAARLIKLLRQGYTIRILLWTFVQSFKVGQAGGLHAFCRASRGAVGLVGPD

SEQ ID NO: 870351 - protein, 31 aa, Homo sapiens
MVQWEEGQRPILNAPGALCNAERSWQGTPKW

SEQ ID NO: 870352 - protein, 106 aa, Homo sapiens [sequence omitted]

SEQ ID NO: 870353 - protein, 117 aa, Homo sapiens
HASGNVYHLKCFTCSTCRNRLVPGDRFHYINGSLFCEHDRPTALINGHLNSLQSNPLLPDQKVNTQQLLISFIRASWKVQPLNLAREFSWVVVFLHALLKKCRLLVVHRVFRSRIAD

SEQ ID NO: 870354 - protein, 165 aa, Homo sapiens
MVNPGSSSQPPPVTAGSLSWKRCAGCGGKIADRFLLYAMDSYWHSRCLKCSCCQAQLGDIGTSCYTKSGMILCRNDYIRLFGNSGACSACGQSIPASELVMRAQGNVYHLKCFTCSTCRNRLVPGDRFHYINGSLFCEHDRPTALINGHLNSLQSNPLLPDQKVC

SEQ ID NO: 870355 - protein, 165 aa, Homo sapiens; identical to SEQ ID NO: 870354

SEQ ID NO: 870356 - protein, 165 aa, Homo sapiens; identical to SEQ ID NO: 870354

SEQ ID NO: 870357 - protein, 180 aa, Homo sapiens
MVNPGSSSQPPPVTAGSLSWKRCAGCGGKIADRFLLYAMDSYWHSRCLKCSCCQAQLGDIGTSCYTKSGMILCRNDYIRLFGNSGACSACGQSIPASELVMRAQGNVYHLKCFTCSTCRNRLVPGDRFHYINGSLFCEHDRPTALINGHLNSLQSNPLLPDQKSAKRVRVMQRISRYRAD

SEQ ID NO: 870358 - protein, 218 aa, Homo sapiens
MVNPGSSSQPPPVTAGSLSWKRCAGCGGKIADRFLLYAMDSYWHSRCLKCSCCQAQLGDIGTSCYTKSGMILCRNDYIRLFGNSGACSACGQSIPASELVMRAQGNVYHLKCFTCSTCRNRLVPGDRFHYINGSLFCEHDRPTALINGHLNSLQSNPLLPDQKVNTQQLLISFIRASWKVQPLNLAREFSWVVVFLHALLKKCRLLVVHRVFRSRIAD

SEQ ID NO: 870359 - protein, 165 aa, Homo sapiens; identical to SEQ ID NO: 870354

SEQ ID NO: 870360 - protein, 165 aa, Homo sapiens; identical to SEQ ID NO: 870354

SEQ ID NO: 870361 - protein, 90 aa, Homo sapiens
SRSVLSHGGTGSGPSTERLVPGLCTIRTSVITLLFPKRPFSWIRHFLIAAVLIALNNVLVILVPTIKYIFGFIAEGSLGNNSVITDVRIG

SEQ ID NO: 870362 - protein, 405 aa, Homo sapiens
MELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNLGYLGYTSGFSLTCMVFFVSVVIYKKFQIPCPLPVLDHSVGNLSFNNTLPMHVVMLPNNSESSDVNFMMDYTHRNPAGLDENQAKGSLHDSGVEYEAHSDDKCEPKYFVFNSRTAYAIPILVFAFVCHPEVLPIYSELKDRSRRKMQTVSNISITGMLVMYLLAALFGYLTFYGEVDEMNYFMPTAKCIH

SEQ ID NO: 870363 - protein, 405 aa, Homo sapiens; identical to SEQ ID NO: 870362

SEQ ID NO: 870364 - protein, 662 aa, Homo sapiens
MELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNLGYLGYTSGFSLTCMVFFVSVVIYKKFQIPCPLPVLDHSVGNLSFNNTLPMHVVMLPNNSESSDVNFMMDYTHRNPAGLDENQAKGSLHDSGVEYEAHSDDKCEPKYFVFNSRTAYAIPILVFAFVCHPEVLPIYSELKDRSRRKMQTVSNISITGMLVMYLLAALFGYLTFYGELRDELLHAYSKVYTLDIPLLMVRLAVLVAVTLTVPIVLFPIRTSVITLLFPKRPFSWIRHFLIAAVLIALNNVLVILVPTIKYIFGFIGASSATMLIFILPAVFYLKLVKKETFRSPQKVGEITGRFQRRLPVISPGTCRRGKSLFLSRMVVYVFKIKPVVHISTQVLLEQCEMMKVYFCCFTSRIRVTACNNHQIVLFPLPSPHPAPPKKVPNICILRTSNKNALVAKLSPFNVFSQSCTKVSGLFTNRGKRHVLGTVSVSVRYMNGQTPV

SEQ ID NO: 870365 - protein, 544 aa, Homo sapiens [sequence omitted]

SEQ ID NO: 870366 - protein, 258 aa, Homo sapiens
MELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNLGYLGYTSGFSLTCMVFFVSVDDLQENKFLFANFYHTKVVLLI

SEQ ID NO: 870367 - protein, 405 aa, Homo sapiens; identical to SEQ ID NO: 870362

SEQ ID NO: 870368 - protein, 165 aa, Homo sapiens
APPDTDQHHELRSIEITGRFQRRLPVISPGTCRRGKSLFLSRMVVYVFKIKPVVHISTQVLLEQCEMMKVYFCCFTSRIRVTACNNHQIVLFPLPSPHPAPPKKVPNICILRTSNKNALVAKLSPFNVFSQSCTKVSGLFTNRGKRHVLGTVSVSVRYMNGQTPV

SEQ ID NO: 870369 - protein, 271 aa, Homo sapiens
GRPSQPCAALQGPGRRTRTHPPTQPRSAMGKNKQPRGQQRQGGPPAADAAGPDDMEPKKGTGAPKECGEEEPRTCCGCRFPLLLALLQLALGIAVTVVGFLMASISSSLLVRDTPFWAGIIVCLVAYLGLFMLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQVFYVGVRICSLTASEGPQQKI

SEQ ID NO: 870370 - protein, 103 aa, Homo sapiens
VKCWGFEHWADEQGFVQFLLISLLRSRAGSAKVWSSYCKSKRCLARPESWSPALSPQAPATASEFSAWCPAAVPGAATGAGGLQSSPRLSAAVHARSFRAPCA

SEQ ID NO: 870371 - protein, 70 aa, Homo sapiens
RQAYALLVLGCVISAWLAQLCQGLGEGYFFPPAAYCVLAESDRNKLDYSLSQTELEGLYCGRIPSIILQK

SEQ ID NO: 870372 - protein, 280 aa, Homo sapiens
MKFRAKIVDGACLNHFTRISNMIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDVSIYLPVLKTMKSVVEKMKNISNHLVIEANLDGELNLKIETELVCVTTHFKDLGNPPLASESTHEDRNVEHMAEVHIDIRKLLQFLAGQQVNPTKALCNIVNNKMVHFDLLHEDVSLQYFIPALS

SEQ ID NO: 870373 - protein, 280 aa, Homo sapiens; identical to SEQ ID NO: 870372

SEQ ID NO: 870374 - protein, 259 aa, Homo sapiens
MIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDVSIYLPVLKTMKSVVEKMKNISNHLVIEANLDGELNLKIETELVCVTTHFKDLGNPPLASESTHEDRNVEHMAEVHIDIRKLLQFLAGQQVNPTKALCNIVNNKMVHFDLLHEDVSLQYFIPALS

SEQ ID NO: 870375 - protein, 280 aa, Homo sapiens; identical to SEQ ID NO: 870372

SEQ ID NO: 870376 - protein, 280 aa, Homo sapiens; identical to SEQ ID NO: 870372

SEQ ID NO: 870377 - protein, 86 aa, Homo sapiens
DVCLYYSVFTLLKRYYLRPASESTHEDRNVEHMAEVHIDIRKLLQFLAGQQVNPTKALCNIVNNKMVHFDLLHEDVSLQYFIPALS

SEQ ID NO: 870378 - protein, 105 aa, Homo sapiens
EEPNSSKTESNTLTLPFRWPQASRSREEEENKRNSLALFRGMVTSLGPPQAPGSPLPRSTPPGPSRSGRVCGGGTSAPPESLTEGQQDAAEAQHPQGPHGVRPYL

SEQ ID NO: 870379 - protein, 124 aa, Homo sapiens
MHSVVPKQREMSQKTNENVERYTQFLQKPQKPIQPYICSTLNDFQEERDFLANNIFPQLNELCNSWGTYFKAVDLSWSALKAPKSLPTHLFRQYSCLRSQRLKLCLDYVNSCFPFFICMLGQTY

SEQ ID NO: 870380 - protein, 85 aa, Homo sapiens
GLQLFSNQMAPRAPHTWDRPFAWAALASKGKRPMNVSREHIHPFREVAAELLPDPRERLFRDRGNGSHGNVFFTLSHLCLGFRWK

SEQ ID NO: 870381 - protein, 458 aa, Homo sapiens
MVAAGVTRPRAPLAANTESSVCRLSSREKISLQDLSKERRPGGAGGPPIQDEDEGEEGPTEPPPAEPRTLNGVSSPPHPSPKSPVQLEEAPFSRRFGLLKTGSSGALGPPERRTAEGAPGAGLQRSASSSWLEGTSTQAKELRLARITPTPSPKLPEPSVLSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQRAEAPDGQGPGPQAAREHRKVGKEWRGPAEGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 870382 - protein, 330 aa, Homo sapiens
MRGKKVPPNHPLQNPEPSMASPPRRTPALRVPWSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQRAEAPDGQGPGPQAAREHRKVGKEWRGPAEGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 870383 - protein, 130 aa, Homo sapiens
GLGRGLGYIGRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 870384 - protein, 188 aa, Homo sapiens
GVCVRAGPAPDARSSPAPAPWRAAPRPAGSGGSGTSTQNLSQNRKSQTEALGRCDPTPPSGLCLLGAQLPGFPAPPASPHPPPDPPLPDPQLYAELRRENERLREALTETTLRLAQLKVELERATQRQERFAERPALLELERFERRALERKAAELEEELKALSDLRADNQRLKDENAALIRVISKLSK

SEQ ID NO: 870385 - protein, 529 aa, Homo sapiens
RYLLSHGANIAAVNSDGDLPLAPAPSSTPPRRRPPAPCWTPPTPTVSAPCTRSSVCRLSSREKISLQDLSKERRPGGAGGPPIQDEDEGEEGPTGEGPESGLLGPREEGSGSLNLEATGIFCDLPGVPTITEPPPAEPRTLNGVSSPPHPSPKSPVQLEEAPFSRRFGLLKTGSSGALGPPERRTAEGAPGAGLQRSASSSWLEGTSTQAKELRLARITPTPSPKLPEPSVLSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQRAEAPDGQGPGPQAAREHRKVGKEWRGPAEGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 870386 - protein, 311 aa, Homo sapiens
MHLGNVCGMNELMQSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQRAEAPDGQGPGPQAAREHRKVGKEWRGPAEGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 870387 - protein, 242 aa, Homo sapiens
SHSLKFPFSQSCGPSPLPRPSWVTHPERPALALLLSKPHLSLLSFSLAADLVGPLLSPPQVLCRVLLPADAGHGGRLWGEGGSAEDAEGHPDDGPHRPLLLLLPLLSTAAAHQISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 870388 - protein, 97 aa, Homo sapiens
MLGPFQYAFLKITLTLVGLFLIPDGIYDPADISEGSTALWINTFLGVSTLLALWTLGIISRQARLHLGEQNMGAKFAMFQVLLICLPTALPPPNKGA

SEQ ID NO: 870389 - protein, 321 aa, Homo sapiens
MEVEDNYGSLQLVLSASHSSPTPQRALGPVELALTSILTLLALGSIAIFLEDAVYLYKNTLCPIKRRTLLWKSSAPTVVSVLCCFGLWIPRSLVLVEMTITSFYAVCFYLLMLVMVEGFGGKEAVLRTLRDTPMMVHTGPCCCCCPCCPRLLLTRKKLQLLMLGPFQYAFLKITLTLVGLFLIPDGIYDPADISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 870390 - protein, 321 aa, Homo sapiens; identical to SEQ ID NO: 870389

SEQ ID NO: 870391 - protein, 52 aa, Homo sapiens
ARQWAGCVLCREGRPSPPLPLFYVPQVLLILTALQPSIFSVLANGGQIACSP

SEQ ID NO: 870392 - protein, 142 aa, Homo sapiens
PPIPIDMLSNTPHISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 870393 - protein, 210 aa, Homo sapiens
MLVMVEGFGGKEAVLRTLRDTPMMVHTGPCCCCCPCCPRLLLTRKKLQLLMLGPFQYAFLKITLTLVGLFLIPDGIYDPADISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 870394 - protein, 289 aa, Homo sapiens
MEVEDNYGSLQLVLSASHSSPTPQRALGPVELALTSILTLLALGSIAIFLEDAVYLYKNTLCPIKRRTLLWKSSAPTVVSVLCCFGLWIPRSLVLVEMTITSFYAVCFYLLMLVMVEGFGGKEAVLRTLRDTPMMVHTGPCCCCCPCCPRLLLTRKKLQLLMLGPFQYAFLKITLTLVGLFLIPDGIYDPADISEGSTALWINTFLGVSTLLALWTLGIISRQARLHLGEQNMGAKFALFQVLLILTALQPSIFSVLANGGQIACSPPYSSKTRSQGEHVKPPVPSWDG

SEQ ID NO: 870395 - protein, 289 aa, Homo sapiens; identical to SEQ ID NO: 870394

SEQ ID NO: 870396 - protein, 140 aa, Homo sapiens
MHRGVGPAFRVVRKMAASGAEPQVLVQYLVLRKDLSQAPFSWPAGALVAQACHAATAALHTHRDHPHTAAYLQELGRMRKVVLEAPDETTLKELAETLQQKNIDHMLWLEQPENIATCIALRPYPKEEVGQYLKKFRLFK

SEQ ID NO: 870397 - protein, 140 aa, Homo sapiens
AAPTTTKFAAVRRKMAASGAEPQVLVQYLVLRKDLSQAPFSWPAGALVAQACHAATAALHTHRDHPHTAAYLQELGRMRKVVLEAPDETTLKELAETLQQKNIDHMLWLEQPENIATCIALRPYPKEEVGQYLKKFRLFK

SEQ ID NO: 870398 - protein, 140 aa, Homo sapiens; identical to SEQ ID NO: 870396

SEQ ID NO: 870399 - protein, 392 aa, Homo sapiens
SICAASCLHATPDCTGMALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVAGAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKGYFRLHRGSNTCGITKFPLTARVQKPDMKPRVSCPP

SEQ ID NO: 870400 - protein, 380 aa, Homo sapiens
SICAASCLHATPDCTGMALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVAGAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKVSVIYWGRGQGRTGLFPPSRPYVP

SEQ ID NO: 870401 - protein, 365 aa, Homo sapiens
SICAASCLHATPDCTGMALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVAGAISPIKDQKNCNCCWAMAAAGNIETLWRISFWDFVDVSVQGGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKGYFRLHRGSNTCGITKFPLTARVQKPDMKPRVSCPP

SEQ ID NO: 870402 - protein, 290 aa, Homo sapiens
SICAASCLHATPDCTGMALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVAGAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHSAGRAGTRADGRDRHRGRGRHAGLLG

SEQ ID NO: 870403 - protein, 116 aa, Homo sapiens
SICAASCLHATPDCTGMALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTAALSC

SEQ ID NO: 870404 - protein, 380 aa, Homo sapiens; identical to SEQ ID NO: 870400

SEQ ID NO: 870405 - protein, 262 aa, Homo sapiens
MGREIRSEEPEESVPFSCDWRKVAGAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKGYFRLHRGSNTCGITKFPLTARVQKPDMKPRVSCPP

SEQ ID NO: 870406 - protein, 176 aa, Homo sapiens
SICAASCLHATPDCTGMALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEETPGGPNGERRAISGCTEGAIPVASPSSRSLPVCRNRI

SEQ ID NO: 870407 - protein, 343 aa, Homo sapiens
KSRFRPLPLSGRAWAAWRILFAMPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGQKIVSCRICKGDHWTTRCPYKDTLGPMQKGAGRAAGPVYWREGEAAGRARAGAGHAEPRQGSMCRRACATGPAAAGKSMQPNRRADDNATIRVTNLSEDTRETDLQELFRPFGSISRIYLAKDKTTGQSKGFAFISFHRREDAARAIAGVSGFGYDHLILNVEWAKPSTN

SEQ ID NO: 870408 - protein, 171 aa, Homo sapiens
SCQIRQQRICKGDHWTTRCPYKDTLGPMQKGAGRAAGPVYWREGEAAGRARAGAGHAEPRQGSMCRRACATGPAAAGKSMQPNRRADDNATIRVTNLSEDTRETDLQELFRPFGSISRIYLAKDKTTGQSKGFAFISFHRREDAARAIAGVSGFGYDHLILNVEWAKPSTN

SEQ ID NO: 870409 - protein, 75 aa, Homo sapiens
SQEMREMEPKGRKSSCRSVSRVSSDKLVTRMVALEGFAFISFHRREDAARAIAGVSGFGYDHLILNVEWAKPSTN

SEQ ID NO: 870410 - protein, 343 aa, Homo sapiens; identical to SEQ ID NO: 870407

SEQ ID NO: 870411 - protein, 343 aa, Homo sapiens; identical to SEQ ID NO: 870407

SEQ ID NO: 870412 - protein, 326 aa, Homo sapiens
KSRFRPLPLSGRAWAAWRILFAMPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGQKIVSCRICKGDHWTTRCPYKDTLGPMQKGAGRAAGPVYWREGEAAGRARAGAGHAEPRQGSMCRRACATGPAAAGKSMQEDTRETDLQELFRPFGSISRIYLAKDKTTGQSKGFAFISFHRREDAARAIAGVSGFGYDHLILNVEWAKPSTN

SEQ ID NO: 870413 - protein, 212 aa, Homo sapiens
KSRFRPLPLSGRAWAAWRILFAMPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGQKIVSCRICKGDHWTTRCPYKDTLGPMQKGAGRAAGPVY

SEQ ID NO: 870414 - protein, 252 aa, Homo sapiens
KSRFRPLPLSGRAWAAWRILFAMPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGQKIVSCRICKGDHWTTRCPYKDTLGPMQKGAGRAAGPVYWREGEAAGRCGGGRVLLSVHGFCPHCCLRAVISRTTVQRV

SEQ ID NO: 870415 - protein, 194 aa, Homo sapiens
MTFITSKEDLNCQEEEDPMNKLKGQKIVSCRICKGDHWTTRCPYKDTLGPMQKGAGRAAGPVYWREGEAAGRARAGAGHAEPRQGSMCRRACATGPAAAGKSMQPNRRADDNATIRVTNLSEDTRETDLQELFRPFGSISRIYLAKDKTTGQSKGFAFISFHRREDAARAIAGVSGFGYDHLILNVEWAKPSTN

SEQ ID NO: 870416 - protein, 269 aa, Homo sapiens
KSRFRPLPLSGRAWAAWRILFAMPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGQKIVSCPNRRADDNATIRVTNLSEDTRETDLQELFRPFGSISRIYLAKDKTTGQSKGFAFISFHRREDAARAIAGVSGFGYDHLILNVEWAKPSTN

SEQ ID NO: 870417 - protein, 127 aa, Homo sapiens
MHWAPMDQLRRARQSWSSRSTGNTDSGHPTPPPHLAPLEASSPKSSPSKACRLHFRSVPSKAPWGSSPHSALTLAPAAAQSLFSPWPPESTRERWSPAPSFCFQVLTLGQGVAAKKPDSPHKVPQER

SEQ ID NO: 870418 - protein, 437 aa, Homo sapiens
VVFARFRFSGRAWAAWRILFAMPTGDFDSKPSWADQVEEEGEDDKCVTSELLKGIPLATGDTSPEPELLPGAPLPPPKEVINGNIKTVTRTPTHAYALHATAHTHTLPRHSAPPPSQRTLTTPRTRLHHRAASPPRTHPTLRNHPLRATHASSLHPTRAPTLPAPTHPLPPLHPPALLPARSTHPPPRHATLHTLPPTEAGPLCNTHLNAAPHALVLHARTLPPAPPPGTTPPAPLHRHYACGAPCPPRAALPRPPPAALLSLRPAPPPPPRPQPSPPPPGHPPPPPTHPCSPPPPAPTAPSPPRRTSPSAPPPHPPPTPPPPGPPLRHTHTPVTTAPSPQPLPALSGPPLPPTPRALRAPTPRPLPPPALPPPRPPPPPHPPPLPHPPPPPPPPPPPLPPPPPPPPPPTPPPPPPPPPPPPPPPPPPPPPPPPPPP

SEQ ID NO: 870419 - protein, 343 aa, Homo sapiens; identical to SEQ ID NO: 870407

SEQ ID NO: 870420 - protein, 108 aa, Homo sapiens
MCRRACATGPAAAGKSMQPNRRADDNATIRVTNLSEDTRETDLQELFRPFGSISRIYLAKDKTTGQSKGFAFISFHRREDAARAIAGVSGFGYDHLILNVEWAKPSTN

SEQ ID NO: 870421 - protein, 237 aa, Homo sapiens
MPTGDFDSKPSWADQVEEEGEDTEIRITLTSRNVKSLEKVCADLIRGAKEKNLKVKGPVRMPTKTLRITTRKTPCGEGSKTWDRFQMRIHKRLIDLHSPSEIVKQITSISIEPGVEVEVTIADAEVNYFNKLMTSGLEKNNNTTQTKKNVCGPTGAPEKRFLKQFGVWGPGAPWVYRCTGGTTGGPRGEKPGLQKQKAGTESAHTKVERTTARGGTPEERFLRQQHSNGGEPSRGRH

SEQ ID NO: 870422 - protein, 343 aa, Homo sapiens; identical to SEQ ID NO: 870407

SEQ ID NO: 870423 - protein, 252 aa, Homo sapiens; identical to SEQ ID NO: 870414

SEQ ID NO: 870424 - protein, 194 aa, Homo sapiens; identical to SEQ ID NO: 870415

SEQ ID NO: 870425 - protein, 194 aa, Homo sapiens; identical to SEQ ID NO: 870415

SEQ ID NO: 870426 - protein, 166 aa, Homo sapiens
RFRPLPLSGRAWAAWRILFAMPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKSVALSPRLKCSGTISTHCNLRLLGSSDSPASASRVAGVTGMCHHAS

SEQ ID NO: 870427 - protein, 223 aa, Homo sapiens
KSRFRPLPLSGRAWAAWRILFAMPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPNRRADDNATIRVTNLSEDTRETDLQELFRPFGSISRIYLAKDKTTGQSKGFAFISFHRREDAARAIAGVSGFGYDHLILNVEWAKPSTN

SEQ ID NO: 870428 - protein, 444 aa, Homo sapiens; identical to SEQ ID NO: 813977

SEQ ID NO: 870429 - protein, 108 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 870430 - protein, 108 aa, Homo sapiens; identical to SEQ ID NO: 870429

SEQ ID NO: 870431 - protein, 108 aa, Homo sapiens; identical to SEQ ID NO: 870429

SEQ ID NO: 870432 - protein, 108 aa, Homo sapiens; identical to SEQ ID NO: 870429

SEQ ID NO: 870433 - protein, 108 aa, Homo sapiens; identical to SEQ ID NO: 870429

SEQ ID NO: 870434 - protein, 108 aa, Homo sapiens; identical to SEQ ID NO: 870429

SEQ ID NO: 870435 - protein, 108 aa, Homo sapiens; identical to SEQ ID NO: 870429

SEQ ID NO: 870436 - protein, 108 aa, Homo sapiens; identical to SEQ ID NO: 870429

SEQ ID NO: 870437 - protein, 108 aa, Homo sapiens; identical to SEQ ID NO: 870429

SEQ ID NO: 870438 - protein, 108 aa, Homo sapiens; identical to SEQ ID NO: 870429

SEQ ID NO: 870439 - protein, 108 aa, Homo sapiens; identical to SEQ ID NO: 870429

SEQ ID NO: 870440 - protein, 108 aa, Homo sapiens; identical to SEQ ID NO: 870429

SEQ ID NO: 870441 - protein, 134 aa, Homo sapiens
MRNRGAPKAHSKKGHNTRDTQAKTQGEGDKQRGQGAQRDAKMRTTGQKERGTRRRKNASNNREQKGEPQRETKHTPGEQHHHKRTGQKRGNKKAPTPASPLPPEQVAEPHQTQRRTKNKKEEAQNTRPNTTKAN

SEQ ID NO: 870442 - protein, 108 aa, Homo sapiens; identical to SEQ ID NO: 870429

SEQ ID NO: 870443 - protein, 108 aa, Homo sapiens; identical to SEQ ID NO: 870429

SEQ ID NO: 870444 - protein, 181 aa, Homo sapiens
ELGLQNFNNRGAHLGDVNRRVAYSYYIYELVKAWRSSRTVRSDASLEDVEPPPGRCWSTPPVAPPARSASAAAMGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 870445 - protein, 108 aa, Homo sapiens; identical to SEQ ID NO: 870429

SEQ ID NO: 870446 - protein, 103 aa, Homo sapiens
MPVSVSSGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 870447 - protein, 108 aa, Homo sapiens; identical to SEQ ID NO: 870429

SEQ ID NO: 870448 - protein, 111 aa, Homo sapiens
MAIISNGAQRRESRTPWNRRQVAVGPRRPSRRPPAQRPPPPWECRWKPSPQETGAPSPSAARPAWCTTPMSVGQRAKLTISPDYAYGATGHPGIIPPHATLVFDVELLKLE

SEQ ID NO: 870449 - protein, 114 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDLPWRDLVPPDMCT

SEQ ID NO: 870450 - protein, 112 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDGAFPDVPLHFV

SEQ ID NO: 870451 - protein, 108 aa, Homo sapiens; identical to SEQ ID NO: 870429

SEQ ID NO: 870452 - protein, 444 aa, Homo sapiens; identical to SEQ ID NO: 813977

SEQ ID NO: 870453 - protein, 134 aa, Homo sapiens; identical to SEQ ID NO: 870441

SEQ ID NO: 870454 - protein, 103 aa, Homo sapiens; identical to SEQ ID NO: 870446

SEQ ID NO: 870455 - protein, 112 aa, Homo sapiens
RPLSPASRPDSPQGDGQILKTSVGLPCLDGWHVQESRRNRSFHAQVGTFLGENTLYVPFVESWHTSAGYLLHSYSGNLNSDLSAFCLLFQTKSCCTSELGSPPPSPEDPPPL

SEQ ID NO: 870456 - protein, 447 aa, Homo sapiens
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIDGDGCRELVVGYTDRVVRAFRWEELGEGPEHLTGQLVSLKKWMLEGQVDSLSVTLGPLGLPELMVSQPGCAYAILLCTWKKDTGSPPASEGPTDGSRETPAARDVVLHQTSGRIHNKNVSTHLIGNIKQGHGTESSGSGLFALCTLDGTLKLMEEMEEADKLLWSVQVDHQLFALEKLDVTGNGHEEVVACAWDGQTYIIDHNRTVVRFQVDENIRAFCAGLYACKEGRNSPCLVYVTFNQKIYVYWEVQLERMESTNLVKLLETKPEYHSLLQELGVDPDDLPVTRALLHQTLYHPDQPPQCAPSSLQDPT

SEQ ID NO: 870457 - protein, 438 aa, Homo sapiens
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIDGDGCRELVVGYTDRVVRAFRWEELGEGPEHLTGQLVSLKKWMLEGQVDSLSVTLGPLGLPELMVSQPGCAYAILLCTWKKDTGSPPASEGPTDGSRETPAARDVVLHQTSGRIHNKNVSTHLIGNIKQGHGTESSGSGLFALCTLDGTLKLMEEMEEADKLLWSVQVDHQLFALEKLDVTGNGHEEVVACAWDGQTYIIDHNRTVVRFQVDENIRAFCAGLYACKEGRNSPCLVYVTFNQKIYVYWEVQLERMESTNLVKLLETKPEYHSLLQELGVGESQKSQWPECPGDPQHAAGAGRGS

SEQ ID NO: 870458 - protein, 429 aa, Homo sapiens
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIDGDGCRELVVGYTDRVVRAFRWEELGEGPEHLTGQLVSLKKWMLEGQVDSLSVTLGPLGLPELMVSQPGCAYAILLCTWKKDTGSPPASEGPTDGSRETPAARDVVLHQTSGRIHNKNVSTHLIGNIKQGTLKLMEEMEEADKLLWSVQVDHQLFALEKLDVTGNGHEEVVACAWDGQTYIIDHNRTVVRFQVDENIRAFCAGLYACKEGRNSPCLVYVTFNQKIYVYWEVQLERMESTNLVKLLETKPEYHSLLQELGVDPDDLPVTRALLHQTLYHPDQPPQCAPSSLQDPT

SEQ ID NO: 870459 - protein, 270 aa, Homo sapiens
MLEGQVDSLSVTLGPLGLPELMVSQPGCAYAILLCTWKKDTGSPPASEGPTDGSRETPAARDVVLHQTSGRIHNKNVSTHLIGNIKQGHGTESSGSGLFALCTLDGTLKLMEEMEEADKLLWSVQVDHQLFALEKLDVTGNGHEEVVACAWDGQTYIIDHNRTVVRFQVDENIRAFCAGLYACKEGRNSPCLVYVTFNQKIYVYWEVQLERMESTNLVKLLETKPEYHSLLQELGVDPDDLPVTRALLHQTLYHPDQPPQCAPSSLQDPT

SEQ ID NO: 870460 - protein, 447 aa, Homo sapiens; identical to SEQ ID NO: 870456

SEQ ID NO: 870461 - protein, 158 aa, Homo sapiens
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIEMGVVSWWWATQTVWCELSAGRS

SEQ ID NO: 870462 - protein, 178 aa, Homo sapiens
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIVGMPTFAGSQESRSQWILEHIPRDWGERENPYSCMHLLCAELP

SEQ ID NO: 870463 - protein, 87 aa, Homo sapiens
RSAALWRKGVARGPVTHIRVGKPASKPGRPASSVRLKEEEAEIGGSGSDVTCCLRWPSALAAVATGVQGIFTGPLRSLCSWRCHEVS

SEQ ID NO: 870464 - protein, 448 aa, Homo sapiens
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIDGDGCRELVVGYTDRVVRAFRWEELGEGPEHLTGQLVSLKKWMLEGQVDSLSVTLGPLGLPELMVSQPGCAYAILLCTWKKDTGSPPASEGPTDGSRETPAARDVVLHQTSGRIHNKNVSTHLIGNIKQGHGTESSGSGLFALCTLDGTLKLMEEMEEADKLLWSVQVDHQLFALEKLDVTGNGHEEVVACAWDGQTYIIDHNRTVVRFQVDENWKTKFPPGVATFLGVAGLYACKEGRNSPCLVYVTFNQKIYVYWEVQLERMESTNLVKLLETKPEYHSLLQELGVGESQKSQWPECPGDPQHAAGAGRGS

SEQ ID NO: 870465 - protein, 472 aa, Homo sapiens
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIVGMPTFAGSQESRSQWILEHIPRDWDGDGCRELVVGYTDRVVRAFRWEELGEGPEHLTGQLVSLKKWMLEGQVDSLSVTLGPLGLPELMVSQPGCAYAILLCTWKKDTGSPPASEGPTDGSRETPAARDVVLHQTSGRIHNKNVSTHLIGNIKQGHGTESSGSGLFALCTLDGTLKLMEEMEEADKLLWSVQVDHQLFALEKLDVTGNGHEEVVACAWDGQTYIIDHNRTVVRFQVDENIRAFCAGLYACKEGRNSPCLVYVTFNQKIYVYWEVQLERMESTNLVKLLETKPEYHSLLQELGVDPDDLPVTRALLHQTLYHPDQPPQCAPSSLQDPT

SEQ ID NO: 870466 - protein, 315 aa, Homo sapiens [sequence omitted]

SEQ ID NO: 870467 - protein, 112 aa, Homo sapiens; identical to SEQ ID NO: 870455

SEQ ID NO: 870468 - protein, 152 aa, Homo sapiens
MKSPDEVLREGELEKRSDSLFQLWKKKRGVLTSDRLSLFPASPRARPKELRFHSILKVDCVERTGKYVYFTIVTTDHKEIDFRCAGESCWNAAIALALIDFQNRRALQDFRSRQERTAPAAPAEDAVAAAAAAPSEPSEPSRPSPQPKPRTP

SEQ ID NO: 870469 - protein, 152 aa, Homo sapiens; identical to SEQ ID NO: 870468

SEQ ID NO: 870470 - protein, 6620 aa, Homo sapiens
MDQPQFSGAPRFLTRPKAFVVSVGKDATLSCQIVGNPTPQVSWEKDQQPVTAGARFRLAQDGDLYRLTILDLALGDSGQYVCRARNAIGEAFAAVGLQVDAEAACAEQAPHFLLRPTSIRVREGSEATFRCRVGGSPRPAVSWSKDGRRLGEPDGPRVRVEELGEASALRIRAARPRDGGTYEVRAENPLGAASAAAALVVDSDAADTASRPGTSTAALLAHLQRRREAMRAEGAPASPPSTGTRTCTVTEGKHARLSCYVTGEPKPETVWKKDGQLVTEGRRHVVYEDAQENFVLKILFCKQSDRGLYTCTASNLVGQTYSSVLVVVREPAVPFKKRLQDLEVREKESATFLCEVPQPSTEAAWFKEETRLWASAKYGIEEEGTERRLTVRNVSADDDAVYICETPEGSRTVAELAVQGNLLRKLPRKTAVRVGDTAMFCVELAVPVGPVHWLRNQEEVVAGGRVAISAEGTRHTLTISQCCLEDVGQVAFMAGDCQTSTRFCVSAPRKPPLQPPVDPVVKARMESSVILSWSPPPHGERPVTIDGYLVEKKKLGTYTWIRCHEAEWVATPELTVADVAEEGNFQFRVSALNSFGQSPYLEFPGTVHLAPKLAVRTPLKAVQAVEGGEVTFSVDLTVASAGEWFLDGQALKASSVYEIHCDRTRHTLTIREVPASLHGAQLKFVANGIESSIRMEVRAAPGLTANKPPAAAAREVLARLHEEAQLLAELSDQAAAVTWLKDGRTLSPGPKYEVQASAGRRVLLVRDVARDDAGLYECVSRGGRIAYQLSVQGLARFLHKDMAGSCVDAVAGGPAQFECETSEAHVHVHWYKDGMELGHSGERFLQEDVGTRHRLVAATVTRQDEGTYSCRVGEDSVDFRLRVSEPKVVFAKEQLARRKLQAEAGASATLSCEVAQAQTEVTWYKDGKKLSSSSKVCMEATGCTRRLVVQQAGQADAGEYSCEAGGQRLSFHLDVKEPKVVFAKDQVAHSEVQAEAGANATLSCEVAQAQAEVMWYKDGKKLSSSLKVHVEAKGCRRRLVVQQAGKTDAGDYSCEARGQRVSFRLHITEPKMMFAKEQSVHNEVQAEAGASAMLSCEVAQAQTEVTWYKDGKKLSSSSKVGMEVKGCTRRLVLPQAGKADAGEYSCEAGGQRVSFHLHITEPKGVFAKEQSVHNEVQAEAGTTAMLSCEVAQPQTEVTWYKDGKKLSSSSKVRMEVKGCTRRLVVQQVGKADAGEYSCEAGGQRVSFQLHITEPKAVFAKEQLVHNEVRTEAGASATLSCEVAQAQTEVTWYKDGKKLSSSSKVRIEAAGCMRQLVVQQAGQADAGEYTCEAGGQRLSFHLDVSEPKAVFAKEQLAHRKVQAEAGAIATLSCEVAQAQTEVTWYKDGKKLSSSSKVRMEAVGCTRRLVVQQACQADTGEYSCEAGGQRLSFSLDVAEPKVVFAKEQPVHREVQAQAGASTTLSCEVAQAQTEVMWYKDGKKLSFSSKVRMEAVGCTRRLVVQQAGQADAGEYSCEAGSQRLSFHLHVAEPKAVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQADAGEYSCEAGGQRLSFRLHVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQPRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLEPQTVEERSSVTLEVELTRPWPELRWTRNATALAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPMCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKTAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRGVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVRTSENAEVVFFENGLRHLLLLKNLRPQDSCRVTFLAGDMVTSAFLTVRGWRLEILEPLKNAAVRAGAQARFTCTLSEAVPVGEASWYINGAAVQPDDSDWTVTADGSHQALLLRSAQPHHAGEVTFACRDAVASARLTVLGLPDPPEDAEVVAHSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVSLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLIAGLDRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDLQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGFQTASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLQALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVLASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEVTEQETKVPKKTVIIEETITTVVKSPRGQRRSPSKSPSRSPSRCSASPLRPGLLAPDLLYLPGAGQPRRPEAEPGQKPVVPTLYVTEAEAHSPALPGLSGPQPKWVEVEETIEVRVKKMGPQGVSPTTEVPRSSSGHLFTLPGATPGGDPNSNNSNNKLLAQEAWAQGTAMVGVREPLVFRVDARGSVDWAASGMGSLEEEGTMEEAGEEEGEDGDAFVTEESQDTHSLGDRDPKILTHNGRMLTLADLEDYVPGEGETFHCGGPGPGAPDDPPCEVSVIQREIGEPTVGQPVLLSVGHALGPRGPLGLFRPEPRGASPPGPQVRSLEGTSFLLREAPARPVGSAPWTQSFCTRIRRSADSGQSSFTTELSTQTVNFGTVGETVTLHICPDRDGDEAAQP

SEQ ID NO: 870471 - protein, 166 aa, Homo sapiens
MALHSGWRNCDSCAGRWWGFSQLHGQCQAWEGSVSPTFSSRPSYPRVVFLTWAVSLTSCVPPCPSPEPKVVFAKEQPAHREVQAEAGASATLSCEVAQAQTEVTWYKDGKKLSSSSKVRVEAVGCTRRLVVQQAGQAEAGEYSCEAGGQQLSFRLQVAGQCFGDAE

SEQ ID NO: 870472 - protein, 2765 aa, Homo sapiens
MALHSGWRNCDSCAGRWWGFSQLHGQCQAWEGSVSPTFSSRPSYPRVVFLTWAVSLTSCVPPCPSPEPKVVFAKEQPAHREVQAEAGASATLSCEVAQAQTEVTWYKDGKKLSSSSKVRVEAVGCTRRLVVQQAGQAEAGEYSCEAGGQQLSFRLQVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLDPQTVEERSSVTLEVELTRPWPELRWTRNATAWAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARFTQDLKTKEASEGATATLQCELSKVAPVEWKKGPETLRDGGRYSLKQDGTRCELQIHDLSVADAGEYSCMCGQERTSATLTVRALPARFTEGLRNEEAMEGATATLQCELSKAAPVEWRKGLEALRDGDKYSLRQDGAVCELQIHGLAMADNGVYSCVCGQERTSATLTVRALPARFIEDMRNQKATEGATVTLQCKLRKAAPVEWRKGPNTLKDGDRYSLKQDGTSCELQIRGLVIADAGEYSCICEQERTSATLTVRALPARFIEDVRNHEATEGATAVLQCELSKAAPVEWRKGSETLRDGDRYSLRQDGTRCELQIRGLAVEDTGEYLCVCGQERTSATLTVRALPARFIDNMTNQEAREGATATLHCELSKVAPVEWRKGPETLRDGDRHSLRQENCLNPGGRGCSEPRSCHCTPAWVIEQAL

SEQ ID NO: 870473 - protein, 2080 aa, Homo sapiens
MDEADNVRLLQEGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARFTQDLKTKEASEGATATLQCELSKVAPVEWKKGPETLRDGGRYSLKQDGTRCELQIHDLSVADAGEYSCMCGQERTSATLTVRALPARFTEGLRNEEAMEGATATLQCELSKAAPVEWRKGLEALRDGDKYSLRQDGAVCELQIHGLAMADNGVYSCVCGQERTSATLTVRALPARFIEDMRNQKATEGATVTLQCKLRKAAPVEWRKGPNTLKDGDRYSLKQDGTSCELQIRGLVIADAGEYSCICEQERTSATLTVRALPARFIEDVRNHEATEGATAVLQCELSKAAPVEWRKGSETLRDGDRYSLRQDGTRCELQIRGLAVEDTGEYLCVCGQERTSATLTVRALPARFIDNMTNQEAREGATATLHCELSKVAPVEWRKGPETLRDGDRHSLRQENCLNPGGRGCSEPRSCHCTPAWVIEQAL

SEQ ID NO: 870474 - protein, 2341 aa, Homo sapiens
MALHSGWRNCDSCAGRWWGFSQLHGQCQAWEGSVSPTFSSRPSYPRVVFLTWAVSLTSCVPPCPSPEPKVVFAKEQPAHREVQAEAGASATLSCEVAQAQTEVTWYKDGKKLSSSSKVRVEAVGCTRRLVVQQAGQAEAGEYSCEAGGQQLSFRLQVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLDPQTVEERSSVTLEVELTRPWPELRWTRNATAWAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRGKDHMWPPE

SEQ ID NO: 870475 - protein, 2465 aa, Homo sapiens
MALHSGWRNCDSCAGRWWGFSQLHGQCQAWEGSVSPTFSSRPSYPRVVFLTWAVSLTSCVPPCPSPEPKVVFAKEQPAHREVQAEAGASATLSCEVAQAQTEVTWYKDGKKLSSSSKVRVEAVGCTRRLVVQQAGQAEAGEYSCEAGGQQLSFRLQVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLDPQTVEERSSVTLEVELTRPWPELRWTRNATAWAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARFTQDLKTKEASEGATATLQCELSKVAPVEWKKGPETLRDGGRYSLKQDGTRCELQIHDLSVADAGEYSCMCGQERTSATLTVRGKVHLSRSAFWCPVVHFLPSISAHCMVSPRLPHSSRHATLSLPAS

SEQ ID NO: 870476 - protein, 747 aa, Homo sapiens
MALHSGWRNCDSCAGRWWGFSQLHGQCQAWEGSVSPTFSSRPSYPRVVFLTWAVSLTSCVPPCPSPEPKVVFAKEQPAHREVQAEAGASATLSCEVAQAQTEVTWYKDGKKLSSSSKVRVEAVGCTRRLVVQQAGQAEAGEYSCEAGGQQLSFRLQVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLDPQTVEERSSVTLEVELTRPWPELRWTRNATAWAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRNIQIVRPLEDVEVMEKDGATFSCEVSHDEVPGQWFWEGSTLRPTDNVR

SEQ ID NO: 870477 - protein, 118 aa, Homo sapiens
VRNHEATEGATAVLQCELSKAAPVEWRKGSETLRDGDRYSLRQDGTRCELQIRGLAVEDTGEYLCVCGQERTSATLTVRGKDPVWSHGLVAWNLSVSVSPPSTSKCGTPVGTLRLCVL

SEQ ID NO: 870478 - protein, 130 aa, Homo sapiens
QAFSPQCCLPDLDGGGPPYASLPSPEPKAVFAKEQPASREVQAEAGTSATLSCEVAQAQTEVTWYKDGKKLSSSSKVRMEAVGCTRRLVVQEAGQADAGEYSCKAGDQRLSFHLHVAGQCFGGPEEPLQR

SEQ ID NO: 870479 - protein, 115 aa, Homo sapiens
SMFCPKNPPDSLMISVTVWSFSALPARFIEDMRNQKATEGATVTLQCKLRKAAPVEWRKGPNTLKDGDRYSLKQDGTSCELQIRGLVIADAGEYSCICEQERTSATLTVRGKDHM

SEQ ID NO: 870480 - protein, 3133 aa, Homo sapiens
ISYGSGLGLEVTWYKDGKKLSSSSKVRMEVKGCTRRLVVQQVGKADAGEYSCEAGGQRVSFQLHITEPKAVFAKEQLVHNEVRTEAGASATLSCEVAQAQTEVTWYKDGKKLSSSSKVRIEAAGCMRQLVVQQAGQADAGEYTCEAGGQRLSFHLDVSEPKAVFAKEQLAHRKVQAEAGAIATLSCEVAQAQTEVTWYKDGKKLSSSSKVRMEAVGCTRRLVVQQACQADTGEYSCEAGGQRLSFSLDVAEPKVVFAKEQPVHREVQAQAGASTTLSCEVAQAQTEVMWYKDGKKLSFSSKVRMEAVGCTRRLVVQQAGQAVAGEYSCEAGSQRLSFHLHVAEPKAVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQAEAGEYSCEAGGQQLSFRLQVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLDPQTVEERSSVTLEVELTRPWPELRWTRNATAWAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARFTQDLKTKEASEGATATLQCELSKVAPVEWKKGPETLRDGGRYSLKQDGTRCELQIHDLSVADAGEYSCMCGQERTSATLTVRALPARFTEGLRNEEAMEGATATLQCELSKAAPVEWRKGLEALRDGDKYSLRQDGAVCELQIHGLAMADNGVYSCVCGQERTSATLTVRALPARFIEDMRNQKATEGATVTLQCKLRKAAPVEWRKGPNTLKDGDRYSLKQDGTSCELQIRGLVIADAGEYSCICEQERTSATLTVRALPARFIEDVRNHEATEGATAVLQCELSKAAPVEWRKGSETLRDGDRYSLRQDGTRCELQIRGLAVEDTGEYLCVCGQERTSATLTVRALPARFIDNMTNQEAREGATATLHCELSKVAPVEWRKGPETLRDGDRHSLRQENCLNPGGRGCSEPRSCHCTPAWVIEQAL

SEQ ID NO: 870481 - protein, 561 aa, Homo sapiens
LVLCFFSSVAGGGGLCRLGSHACVRVLCALSLLACWYNNLSSHAALAILGAVPIFSRALSSLPQRRDHHHCGEEPTWPTTVPQQVPLPLTFPLLCQPAEARPTGPRPAVPARCWPAPQAGGRTRPEARVPTLYVTEAEAHSPALPGLSGPQPKWVEVEETIEVRVKKMGPQGVSPTTEVPRSSSGHLFTLPGATPGGDPNSNNSNNKLLAQEAWAQGTAMVGVREPLVFRVDARGSVDWAASGMGSLEEEGTMEEAGEEEGEDGDAFVTEESQDTHSLGDRDPKILTHNGRMLTLADLEDYVPGEGETFHCGGPGPGAPDDPPCEVSVIQREIGEPTVGQPVLLSVGHALGPRGPLGLFRPEPRGASPPGPQVRSLEGTSFLLREAPARPVGSAPWTQSFCTRIRRSADSGQSSFTTELSTQTVNFGTVGETVTLHICPDRDGDEAAQPDAAAMVAWGSGEKGVSLRPRTLPGLSSSPGSLLRALPVPGHGPFLPHSTSARRTGWCLQCWNDRLKDLSSGLFPVSLAGASGLWTKDVALGICPVPTWAWSLPPGPSHSCQA

SEQ ID NO: 870482 - protein, 152 aa, Homo sapiens
FPGTVHLGKWDLPVTTYGAAHLPRNPPGPASGEARVASWGPSVGRGAAKALPWCSVRGGRIGDPTTGPLGACLSPADPGDGAPGLPHSGGACRMLEGSQGSCTLSLFLHEPDSCYGRSVCWLGFLEEEHLGLGSVGREGEGRDLLSTPHSSS

SEQ ID NO: 870483 - protein, 732 aa, Homo sapiens
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYVQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 870484 - protein, 732 aa, Homo sapiens; identical to SEQ ID NO: 870483

SEQ ID NO: 870485 - protein, 732 aa, Homo sapiens; identical to SEQ ID NO: 870483

SEQ ID NO: 870486 - protein, 640 aa, Homo sapiens
MTTFPSEEHLSCHTGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYVQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 870487 - protein, 732 aa, Homo sapiens
PDECGVVLGAEESATGAVGRRPALGRGLGRCWPVVLRCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGCFLTGHRHTPPHSGATAVQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYVQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 870488 - protein, 710 aa, Homo sapiens
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRSWGVCFTYGTWFGLEAFACMGQTYRDGTACAEVSRACDFLLSRQMADGGWGEDFESCEERRYVQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 870489 - protein, 185 aa, Homo sapiens [sequence omitted]

SEQ ID NO: 870490 - protein, 158 aa, Homo sapiens [sequence omitted]

SEQ ID NO: 870491 - protein, 732 aa, Homo sapiens; identical to SEQ ID NO: 870483

SEQ ID NO: 870492 - protein, 732 aa, Homo sapiens; identical to SEQ ID NO: 870483

SEQ ID NO: 870493 - protein, 732 aa, Homo sapiens; identical to SEQ ID NO: 870483

SEQ ID NO: 870494 - protein, 732 aa, Homo sapiens; identical to SEQ ID NO: 870483

SEQ ID NO: 870495 - protein, 732 aa, Homo sapiens; identical to SEQ ID NO: 870483

SEQ ID NO: 870496 - protein, 732 aa, Homo sapiens; identical to SEQ ID NO: 870483

SEQ ID NO: 870497 - protein, 559 aa, Homo sapiens
MNVGLFSPPSGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYVQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 870498 - protein, 732 aa, Homo sapiens; identical to SEQ ID NO: 870483

SEQ ID NO: 870499 - protein, 158 aa, Homo sapiens [sequence omitted]

SEQ ID NO: 870500 - protein, 579 aa, Homo sapiens
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEG

SEQ ID NO: 870501 - protein, 101 aa, Homo sapiens
AVAFPHLILCRWYKDITVSIPSTARLLGPFITAWGWRAIIGVIACPPAGARALEAQDLSGEGQGPEECSQLSASQMPPRGPHETPSGRWKGLRVAGKLGQL

SEQ ID NO: 870502 - protein, 80 aa, Homo sapiens
STLLAWSSSLPAPGAGRWSLGTVSRAEVRRVRPLAMAAWLGQPGQGKKRCKSPNAGTSGVAGTQPGAVGGQGAMLLSWRQ

SEQ ID NO: 870503 - protein, 475 aa, Homo sapiens
MWHAISRTSRMSQSGCPSGLLADKNISSSATRVIVKTAGNQKDFMVADDISVRQFKEMLLAHFQCQMDQLVLVFMGCLLKDHDTLSQRGIMDGHTIYLVIKSKQGSRSLAHSFRDLPTNDPCHRDRNTKGNSSRVHQPTGMNQAPVELAHFVGSDAPKVHTQNLEVSHPECKAQMLENPSIQRLLSNMEFMWQFISEHLDTQQLMQQNPEVSRLLLDNSEILLQTLELARNLAMIQEIMQIQQPSQNLEYPLNPQPYLGLETMPGGNNALGQNYADINDQMLNSMQDPFGGNPFTALLAGQVLEQVQSSPPPPPPSQEQQDQLTQHPATRVIYNSSGGFSSNTSANDTLNKVNHTSKANTAMISTKGQSHICATRQPAWIPALPSIELTQQLQEEYKDATVSLSSSRQTLKGDLQLSDEQSSSQITGGMMQLLMNNPYLAAQIMLFTSMPQLSEQWRQQLPTFLQQTQISDLLSA

SEQ ID NO: 870504 - protein, 412 aa, Homo sapiens
QRPRPARTPPGITLSLPHPQGGRTLRNHQPRLIPRGSMEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQVNRPLTMRKDGIQTRNRKASGKGKKKRGSSLGGTGAAEGPEHYCGGSAQLMRAQSMASRGGVVSFSSCSQNSGQPKSLGPRHPLA

SEQ ID NO: 870505 - protein, 450 aa, Homo sapiens
QRPRPARTPPGITLSLPHPQGGRTLRNHQPRLIPRGSMEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQVNRPLTMRKDGIQTRNRKASGKGKKKRGSSLGGTGAAEGPAGGFMVVAGGSGSGNCGEVASGLTLGPPGTAHLYQGLGPVVLSGPVSHLMPFPGPLLGSPTGSFPTGPMPPTTSTTVVAPLSS

SEQ ID NO: 870506 - protein, 337 aa, Homo sapiens
QRPRPARTPPGITLSLPHPQGGRTLRNHQPRLIPRGSMEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQSTTVVAPLSS

SEQ ID NO: 870507 - protein, 765 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITFGRMVQVHELGCEGISKSYVFRGTKDLSAKQLQEMLGLSKVPVTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 870508 - protein, 485 aa, Homo sapiens
FFRKKFLIFVGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 870509 - protein, 743 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITFGRMVQVHELGCEGISKSYVFRGTKDLSAKQLQEMLGLSKVPVTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQESGAPILTDDVSLQVFMDHLKKLAVSSAA

SEQ ID NO: 870510 - protein, 765 aa, Homo sapiens; identical to SEQ ID NO: 870507

SEQ ID NO: 870511 - protein, 748 aa, Homo sapiens [sequence omitted]

SEQ ID NO: 870512 - protein, 765 aa, Homo sapiens; identical to SEQ ID NO: 870507

SEQ ID NO: 870513 - protein, 752 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITFGRMVQVHELGCEGISKSYVFRGTKDLSAKQLQEMLGLSKVPVTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQSSVNLFVCLFVVRFAVRCTCLPSDFNRLLHKADRKVRR

SEQ ID NO: 870514 - protein, 765 aa, Homo sapiens; identical to SEQ ID NO: 870507

SEQ ID NO: 870515 - protein, 463 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITFGRMVQVHELGCEGISKSYVFRGTKDLSAKQLQEMLGLSKVPVTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENVSCVYSKKKIQDQELWLALCNPRYLGS

SEQ ID NO: 870516 - protein, 72 aa, Homo sapiens
PPPTGRAWRKRYTLTRTMDDMGNLPGRHCSSVAMIYVTVYTVAWQLQTADLLGLPMQHEAAFLYCYIIIHIL

SEQ ID NO: 870517 - protein, 74 aa, Homo sapiens
NNPLANEVDNARRKTPGLQREREESRALRSKASVSPRSIHHEQSSPSRVEKIYGQEVIIEIKWWQTCPRNIAGI

SEQ ID NO: 870518 - protein, 84 aa, Homo sapiens
VVCVGGVRRGYYVVARVGLDGSDPRVVQGAVRVFYGGGRGTVSGARFLWRRLGREVEVAYWCRGPQPGGVLEDFFLRGWRRAHK

SEQ ID NO: 870519 - protein, 84 aa, Homo sapiens; identical to SEQ ID NO: 870518

SEQ ID NO: 870520 - protein, 84 aa, Homo sapiens; identical to SEQ ID NO: 870518

SEQ ID NO: 870521 - protein, 84 aa, Homo sapiens; identical to SEQ ID NO: 870518

SEQ ID NO: 870522 - protein, 74 aa, Homo sapiens; identical to SEQ ID NO: 870517

SEQ ID NO: 870523 - protein, 84 aa, Homo sapiens; identical to SEQ ID NO: 870518

SEQ ID NO: 870524 - protein, 84 aa, Homo sapiens; identical to SEQ ID NO: 870518

SEQ ID NO: 870525 - protein, 74 aa, Homo sapiens; identical to SEQ ID NO: 870517

SEQ ID NO: 870526 - protein, 84 aa, Homo sapiens; identical to SEQ ID NO: 870518

SEQ ID NO: 870527 - protein, 84 aa, Homo sapiens; identical to SEQ ID NO: 870518

SEQ ID NO: 870528 - protein, 74 aa, Homo sapiens; identical to SEQ ID NO: 870517

SEQ ID NO: 870529 - protein, 74 aa, Homo sapiens; identical to SEQ ID NO: 870517

SEQ ID NO: 870530 - protein, 74 aa, Homo sapiens; identical to SEQ ID NO: 870517

SEQ ID NO: 870531 - protein, 84 aa, Homo sapiens; identical to SEQ ID NO: 870518

SEQ ID NO: 870532 - protein, 84 aa, Homo sapiens; identical to SEQ ID NO: 870518

SEQ ID NO: 870533 - protein, 84 aa, Homo sapiens; identical to SEQ ID NO: 870518

SEQ ID NO: 870534 - protein, 74 aa, Homo sapiens; identical to SEQ ID NO: 870517

SEQ ID NO: 870535 - protein, 84 aa, Homo sapiens; identical to SEQ ID NO: 870518

SEQ ID NO: 870536 - protein, 84 aa, Homo sapiens; identical to SEQ ID NO: 870518

SEQ ID NO: 870537 - protein, 84 aa, Homo sapiens; identical to SEQ ID NO: 870518

SEQ ID NO: 870538 - protein, 84 aa, Homo sapiens; identical to SEQ ID NO: 870518

SEQ ID NO: 870539 - protein, 74 aa, Homo sapiens; identical to SEQ ID NO: 870517

SEQ ID NO: 870540 - protein, 136 aa, Homo sapiens
SGDRRAGGCASGRGTRSRHRRCRLYGRVRTEERKGRSRVEPKLPPDLTPDPRAAWRAWSVAVSFGAGGDCSFGRKEEAQAASSGSCAHHPKVRHLAPNRPSKSRTDRGVTLQPDLHLLQGESAPPFPWRGVRPSVG

SEQ ID NO: 870541 - protein, 711 aa, Homo sapiens
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKGIVTPEMFKKMSNSEIIQHLTEQFNEDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGLLTDADCESVYPVVYPSNRGLASAAGEFLYWKLFYPECEIRTMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQVGAGAGQWDTPNKGGRGCKTGDVD

SEQ ID NO: 870542 - protein, 711 aa, Homo sapiens; identical to SEQ ID NO: 870541

SEQ ID NO: 870543 - protein, 711 aa, Homo sapiens; identical to SEQ ID NO: 870541

SEQ ID NO: 870544 - protein, 711 aa, Homo sapiens; identical to SEQ ID NO: 870541

SEQ ID NO: 870545 - protein, 499 aa, Homo sapiens
MDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGLLTDADCESVYPVVYPSNRGLASAAGEFLYWKLFYPECEIRTMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQVGAGAGQWDTPNKGGRGCKTGDVD

SEQ ID NO: 870546 - protein, 711 aa, Homo sapiens; identical to SEQ ID NO: 870541

SEQ ID NO: 870547 - protein, 164 aa, Homo sapiens
MLVEAGVNRHRGRGGALRGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 870548 - protein, 110 aa, Homo sapiens
MEIAHSLLDFWNIFLSLFCVLMIRSINMFESKKKTQNKKTKKKEDHNHNKTAGTPSTARREQKAETTHRATGQTERTDSPSAAAPQHGTNAPETKDSAASNAQTTGKPTE

SEQ ID NO: 870549 - protein, 1227 aa, Homo sapiens
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKGIVTPEMFKKMSNSEIIQHLTEQFNEDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGLLTDADCESVYPVVYPSNRGLASAAGEFLYWKLFYPECEIRTMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHISKSDASQKQLSSLRDRMVAFCELCQSCLSDVDTEIQEQAFVLLSDLLLIFSPQMIVGGRDFLRPLVFFPEATLQSELASFLMDHVFIQPGDLGSGDSQEDHLQIERLHQRRRLLAGFCKLLLYGVLEMDAASDVFKHYNKNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 870550 - protein, 711 aa, Homo sapiens; identical to SEQ ID NO: 870541

SEQ ID NO: 870551 - protein, 711 aa, Homo sapiens; identical to SEQ ID NO: 870541

SEQ ID NO: 870552 - protein, 711 aa, Homo sapiens; identical to SEQ ID NO: 870541

SEQ ID NO: 870553 - protein, 380 aa, Homo sapiens
MQSYSTSFLTDSYLKYIGWTLHDKHREVRLKCVKALKGLYGNRDLTTRLELFTSRFKDRMVSMVMDREYDVAVEAVRLLILILKNMEGLLTDADCESVYPVVYPSNRGLASAAGEFLYWKLFYPECEIRTMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQVGAGAGQWDTPNKGGRGCKTGDVD

SEQ ID NO: 870554 - protein, 345 aa, Homo sapiens
MGCWRWMQPQMFSNTQQGNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 870555 - protein, 68 aa, Homo sapiens
MWIREGPAEGPVAPSGFWFYLFHRLSYLEKCLQHVSQAPGHPWGPVTTYCHSLSPVENTAETSPQVLP

SEQ ID NO: 870556 - protein, 454 aa, Homo sapiens
MRPRSAVLPAGPDPGLTSAPRPAPRPSGPARGRPVGCEEELCLACRQRRADGGRRSKMNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 870557 - protein, 445 aa, Homo sapiens
RGEVVRGEVEGEGRGYLSGPARGRPVGCEEELCLACRQRRADGGRRSKMNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 870558 - protein, 454 aa, Homo sapiens; identical to SEQ ID NO: 870556

SEQ ID NO: 870559 - protein, 454 aa, Homo sapiens; identical to SEQ ID NO: 870556

SEQ ID NO: 870560 - protein, 454 aa, Homo sapiens; identical to SEQ ID NO: 870556

SEQ ID NO: 870561 - protein, 440 aa, Homo sapiens
MRPRSAVLPAGPDPGLTSAPRPAPRPSGPARGRPVGCEEELCLACRQRRADGGRRSKMNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSFFSLFFSCFYFFFFLKFFSYFFPLFSAIVKLGLNPEVNIEGGAIALGHPLGASGCRILVTLLHTLERMGRSRGVAALCIGGGMGIAMCVQRE

SEQ ID NO: 870562 - protein, 373 aa, Homo sapiens
MRPRSAVLPAGPDPGLTSAPRPAPRPSGPARGRPVGCEEELCLACRQRRADGGRRSKMNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSGLLWEGPSPKKGCKPGPGSHFTKHS

SEQ ID NO: 870563 - protein, 238 aa, Homo sapiens
MRPRSAVLPAGPDPGLTSAPRPAPRPSGPARGRPVGCEEELCLACRQRRADGGRRSKMNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITGCSSVPEQDRECTESWPF

SEQ ID NO: 870564 - protein, 299 aa, Homo sapiens
MELPDDLWVRPKSCVPCSPVNRDRRLQHCGCRRHGKYEQGEMPLTDSILCDGLTDAFHNCHMGITAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 870565 - protein, 454 aa, Homo sapiens; identical to SEQ ID NO: 870556

SEQ ID NO: 870566 - protein, 394 aa, Homo sapiens
MRPRSAVLPAGPDPGLTSAPRPAPRPSGPARGRPVGCEEELCLACRQRRADGGRRSKMNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELQY

SEQ ID NO: 870567 - protein, 308 aa, Homo sapiens [sequence omitted]

SEQ ID NO: 870568 - protein, 391 aa, Homo sapiens
MVRGLTINRCIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 870569 - protein, 403 aa, Homo sapiens
MGSHPVLRIWGNRRATAASLGRSGGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 870570 - protein, 372 aa, Homo sapiens
MRPRSAVLPAGPDPGLTSAPRPAPRPSGPARGRPVGCEEELCLACRQRRADGGRRSKMNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSNVCSERMNCLNFEQPQFLFKLIKY

SEQ ID NO: 870571 - protein, 299 aa, Homo sapiens; identical to SEQ ID NO: 870564

SEQ ID NO: 870572 - protein, 358 aa, Homo sapiens
MRPRSAVLPAGPDPGLTSAPRPAPRPSGPARGRPVGCEEELCLACRQRRADGGRRSKMNAGSDPVVIVSAARTIIGSFNGALAAVPVQDLGSTVIKEVLKRATVAPEDVSEAPHLAYLRTGVKIAENVAKKWQVSREDQDKVAVLSQNRTENAQKAGHFDKEIVPVLVSTRRGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 870573 - protein, 167 aa, Homo sapiens
MSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 870574 - protein, 165 aa, Homo sapiens
MADFDEIYEEEEDEERALEEQLLKYSPDPVVVRGSGHVTVFGLSNKFESEFPSSLTGKVAPEEFKASINRVNSCLKKNLPVNVRWLLCGCLCCCCTLGCSMWPVICLSKRTRRSIEKLLEWENNRLYHKLCLHWRLSKRKCETNNMMEYVILIEFLPKTPIFRPD

SEQ ID NO: 870575 - protein, 165 aa, Homo sapiens; identical to SEQ ID NO: 870574

SEQ ID NO: 870576 - protein, 112 aa, Homo sapiens
MADFDEIYEEEEDEERALEEQLLKYSPDPVVVRGSGHVTVFGLSNKFESEFPSSLTGKVAPEEFKASINRVNSCLKKNLPVNVRWLLCGCLCCCCTLGCSMWPVICLSKRVS

SEQ ID NO: 870577 - protein, 106 aa, Homo sapiens
SRGSPSSSINRVNSCLKKNLPVNVRWLLCGCLCCCCTLGCSMWPVICLSKRTRRSIEKLLEWENNRLYHKLCLHWRLSKRKCETNNMMEYVILIEFLPKTPIFRPD

SEQ ID NO: 870578 - protein, 137 aa, Homo sapiens
MADFDEIYEEEEDEERALEEQLLKYSPDPVVVRGSGHVTVFGLSNKFESEFPSSLTGKVAPEEFKASINRVNSCLKKNLPVNTRRSIEKLLEWENNRLYHKLCLHWRLSKRKCETNNMMEYVILIEFLPKTPIFRPD

SEQ ID NO: 870579 - protein, 721 aa, Homo sapiens
MLLPVFTLKLRHKISPRMVAIGRYDGTHPCLAAATQTGKVFIHNPHTRNQHVSASRVFQSPLESDVSLLNINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRVVVWLGQNFLLPEDTHIQNAPFQVCFTSLRNGGHLHIKIKLSGEITINTDDIDLAGDIIQSMASFFAIEDLQVEADFPVYFEELRKVLVKVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 870580 - protein, 194 aa, Homo sapiens
CVSLIGHSTQFHVFESTRQLPRFSMYALTSLDPASEPISYVNFTIAERAQRVVVWLGQNFLLPEDTHIQNAPFQVCFTSLRNGGHLHIKIKLSGEITINTDDIDLAGDIIQSMASFFAIEDLQVEADFPVYFEELRKVLVKVDEYHSVHQKLSADMADHSNLIRSLLVGAEDARLMRDIENKLKKSFFGNLLRP

SEQ ID NO: 870581 - protein, 721 aa, Homo sapiens; identical to SEQ ID NO: 870579

SEQ ID NO: 870582 - protein, 417 aa, Homo sapiens
MLLPVFTLKLRHKISPRMVAIGRYDGTHPCLAAATQTGKVFIHNPHTRNQHVSASRVFQSPLESDVSLLNINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNGKTVLTAGI

SEQ ID NO: 870583 - protein, 510 aa, Homo sapiens
MLLPVFTLKLRHKISPRMVAIGRYDGTHPCLAAATQTGKVFIHNPHTRNQHVSASRVFQSPLESDVSLLNINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRQ

SEQ ID NO: 870584 - protein, 721 aa, Homo sapiens; identical to SEQ ID NO: 870579

SEQ ID NO: 870585 - protein, 148 aa, Homo sapiens
VSTIFFLAASFYTFLSTLLFKHVPLISLFSRPKYFALLELQFLHPKLILSIFRLTSPHLSHNPFLRDLAPPNPHVHASSPRRPFLECLSLKKLLQENFRTFFKLFLNLNLVIHVQISRVDPIIQNLMILWDVRAPRYGGFKVVGRPSQ

SEQ ID NO: 870586 - protein, 239 aa, Homo sapiens [sequence omitted]

SEQ ID NO: 870587 - protein, 148 aa, Homo sapiens; identical to SEQ ID NO: 870585

SEQ ID NO: 870588 - protein, 466 aa, Homo sapiens
MLLPVFTLKLRHKISPRMVAIGRYDGTHPCLAAATQTGKVFIHNPHTRNQHVSASRVFQSPLESDVSLLNINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSR

SEQ ID NO: 870589 - protein, 417 aa, Homo sapiens; identical to SEQ ID NO: 870582

SEQ ID NO: 870590 - protein, 148 aa, Homo sapiens; identical to SEQ ID NO: 870585

SEQ ID NO: 870591 - protein, 137 aa, Homo sapiens
NPHTRNQHVSASRVFQSPLESDVSLLNINQAVSCLTAGVLNPELGYDALLVGTQTNLLAYDVYNNSDLFYREASITFITIKLSLLINVHFLCLEEIRSFILVCLLYDCYSIGKQHGDFAVNICFMYSELIYLVMVAN

SEQ ID NO: 870592 - protein, 721 aa, Homo sapiens; identical to SEQ ID NO: 870579

SEQ ID NO: 870593 - protein, 721 aa, Homo sapiens; identical to SEQ ID NO: 870579

SEQ ID NO: 870594 - protein, 922 aa, Homo sapiens
MLLPVFTLKLRHKISPRMVAIGRYDGTHPCLAAATQTGKVFIHNPHTRNQHVSASRVFQSPLESDVSLLNINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEVRSSTSNYGNLEQDRSVLSDETSSESAGASPNPGGFRIKAWGGGQTELYVMVRKAIKILIKIYFEKTELNREKLLHIVEYIKGISFNELIHANNNNGNHLLCTYCMPGSALSTLYEVTYVNPYNNPNRKINYYYFYRGGKWCSGFLFVCLFVLRQSFTPSPRLECGGAISAYCKLHLPSSSDSHASASRVAGTTGTHHHAWIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRVVVWLGQNFLLPEDTHIQNAPFQVCFTSLRNGGHLHIKIKLSGEITINTDDIDLAGDIIQSMASFFAIEDLQVEADFPVYFEELRKVLVKVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 870595 - protein, 793 aa, Homo sapiens
MLLPVFTLKLRHKISPRMVAIGRYDGTHPCLAAATQTGKVFIHNPHTRNQHVSASRVFQSPLESDVSLLNINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGESKLGGEKSLKSHVFHLIGSKYQEISPEVFVPRSCSSNKFTKVGENLGFCFEEQVIDDLKVYLVILAVFSFCSVRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRVVVWLGQNFLLPEDTHIQNAPFQVCFTSLRNGGHLHIKIKLSGEITINTDDIDLAGDIIQSMASFFAIEDLQVEADFPVYFEELRKVLVKVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 870596 - protein, 522 aa, Homo sapiens
MLLPVFTLKLRHKISPRMVAIGRYDGTHPCLAAATQTGKVFIHNPHTRNQHVSASRVFQSPLESDVSLLNINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRVSISLFSFNAFTQ

SEQ ID NO: 870597 - protein, 146 aa, Homo sapiens
VSFHLSGFKKFVRPFSFLSVHGLQVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 870598 - protein, 148 aa, Homo sapiens; identical to SEQ ID NO: 870585

SEQ ID NO: 870599 - protein, 279 aa, Homo sapiens
MPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 870600 - protein, 368 aa, Homo sapiens
MLGEGLAASTAAAELGRGTKAKVSRGSSPFVCRRPAARRCGSTAGLEEGSSCEDGTEQRGGTRGRPRRVPRPGGAEACTSGGRKEGVDEEARALPPTRPLGGAAITLFWATRLLFLRGTRIPSSTTLSPPRHDSLSLDGGTVNPPRVREPTGREAFGPSPASSDWLPARWRNGRGGRPRARLCSGWTAAEEARRNPTLGGLLGRQRLLLRMGAGRLGAPMERHGRASATSVSSAGEQAAGDPEGRRQEPLRRRASSASVPAVGASAEGTRRDRLGSYSGPTSVSRQRVESLRKKRPLFPWFGLDIGGTLVKLVYFEPKDITAEEEEEEVESLKSIRKYLTSNVAYGSTGIRDVHLELKDLTLCGRKDR

SEQ ID NO: 870601 - protein, 418 aa, Homo sapiens
MLGEGLAASTAAAELGRGTKAKVSRGSSPFVCRRPAARRCGSTAGLEEGSSCEDGTEQRGGTRGRPRRVPRPGGAEACTSGGRKEGVDEEARALPPTRPLGGAAITLFWATRLLFLRGTRIPSSTTLSPPRHDSLSLDGGTVNPPRVREPTGREAFGPSPASSDWLPARWRNGRGGRPRARLCSGWTAAEEARRNPTLGGLLGRQRLLLRMGAGRLGAPMERHGRASATSVSSAGEQAAGDPEGRRQEPLRRRASSASVPAVGASAEGTRRDRLGSYSGPTSVSRQRVESLRKKRPLFPWFGLDIGGTLVKLVYFEPKDITAEEEEEEVESLKSIRKYLTSNVAYGSTGIRDVHLELKDLTLCGRKGNLHFIRFPTHDMPAFIQMGRDKNFSSLHTVFCATGGGAYKFEQDFLTVCIF

SEQ ID NO: 870602 - protein, 131 aa, Homo sapiens
MLGEGLAASTAAAELGRGTKAKVSRGSSPFVCRRPAARRCGSTAGLEEGSSCEDGTEQRVFPWFGLDIGGTLVKLVYFEPKDITAEEEEEEVESLKSIRKYLTSNVAYGSTGIRDVHLELKDLTLCGRKDR

SEQ ID NO: 870603 - protein, 134 aa, Homo sapiens
MASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 870604 - protein, 368 aa, Homo sapiens; identical to SEQ ID NO: 870600

SEQ ID NO: 870605 - protein, 418 aa, Homo sapiens; identical to SEQ ID NO: 870601

SEQ ID NO: 870606 - protein, 518 aa, Homo sapiens
MLGEGLAASTAAAELGRGTKAKVSRGSSPFVCRRPAARRCGSTAGLEEGSSCEDGTEQRGGTRGRPRRVPRPGGAEACTSGGRKEGVDEEARALPPTRPLGGAAITLFWATRLLFLRGTRIPSSTTLSPPRHDSLSLDGGTVNPPRVREPTGREAFGPSPASSDWLPARWRNGRGGRPRARLCSGWTAAEEARRNPTLGGLLGRQRLLLRMGAGRLGAPMERHGRASATSVSSAGEQAAGDPEGRRQEPLRRRASSASVPAVGASAEGTRRDRLGSYSGPTSVSRQRVESLRKKRPLFPWFGLDIGGTLVKLVYFEPKDITAEEEEEEVESLKSIRKYLTSNVAYGSTGIRDVHLELKDLTLCGRKGNLHFIRFPTHDMPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSFGGRNFFGVWWVFTGWATF

SEQ ID NO: 870607 - protein, 316 aa, Homo sapiens
MLGEGLAASTAAAELGRGTKAKVSRGSSPFVCRRPAARRCGSTAGLEEGSSCEDGTEQRGGTRGRPRRVPRPGGAEACTSGGRKEGVDEEARALPPTRPLGGAAITLFWATRLLFLRGTRIPSSTTLSPPRHDSLSLDGGTVNPPRVREPTGREAFGPSPASSDWLPARWRNGRGGRPRARLCSGWTAAEEARRNPTLGGLLGRQRLLLRMGAGRLGAPMERHGRASATSVSSAGEQAAGDPEGRRQEPLRRRASSASVPAVGASAEGTRRDRLGSYSGPTSVSRQRVESLRKKRPRKCSVGRPPGPPCPPFRPTL

SEQ ID NO: 870608 - protein, 108 aa, Homo sapiens
MGFFFPHHSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 870609 - protein, 657 aa, Homo sapiens
MLGEGLAASTAAAELGRGTKAKVSRGSSPFVCRRPAARRCGSTAGLEEGSSCEDGTEQRGGTRGRPRRVPRPGGAEACTSGGRKEGVDEEARALPPTRPLGGAAITLFWATRLLFLRGTRIPSSTTLSPPRHDSLSLDGGTVNPPRVREPTGREAFGPSPASSDWLPARWRNGRGGRPRARLCSGWTAAEEARRNPTLGGLLGRQRLLLRMGAGRLGAPMERHGRASATSVSSAGEQAAGDPEGRRQEPLRRRASSASVPAVGASAEGTRRDRLGSYSGPTSVSRQRVESLRKKRPLFPWFGLDIGGTLVKLVYFEPKDITAEEEEEEVESLKSIRKYLTSNVAYGSTGIRDVHLELKDLTLCGRKGNLHFIRFPTHDMPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 870610 - protein, 401 aa, Homo sapiens
FSRARTLSPHGGPSLVRGLTSGWRPRVLRKRYLRGPPAPIVFPWFGLDIGGTLVKLVYFEPKDITAEEEEEEVESLKSIRKYLTSNVAYGSTGIRDVHLELKDLTLCGRKGNLHFIRFPTHDMPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 870611 - protein, 134 aa, Homo sapiens; identical to SEQ ID NO: 870603

SEQ ID NO: 870612 - protein, 418 aa, Homo sapiens; identical to SEQ ID NO: 870601

SEQ ID NO: 870613 - protein, 368 aa, Homo sapiens; identical to SEQ ID NO: 870600

SEQ ID NO: 870614 - protein, 452 aa, Homo sapiens
LCLRPFLLCPQLSRLLLSEPTFGIFLPYSPDGGTRRLEKAKVSLNDCLACSGCITSAETVLITQQSHEELKKVLDANKMAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTARSPQQVMGSLVKDFFAQQQHLTPDKIYHVTVMPCYDKKLEASRPDFFNQEHQTRDVDCVLTTGEVFRLLEEEGVSLPDLEPAPLDSLCSGASAEEPTSHRGGGSGGYLEHVFRHAARELFGIHVAEVTYKPLRNKDFQEVTLEKEGQVLLHFAMAYGFRNIQNLVQRLKRGRCPYHYVEVMACPSGCLNGGGQLQAPDRPSRELLQHVERLYGMVRAEAPEDAPGVQELYTHWLQGTDSECAGRLLHTQYHAVEKASTGLGIRW

SEQ ID NO: 870615 - protein, 453 aa, Homo sapiens
GGSAAVMASPFSGALQLTDLDDFIGPSQECIKPVKVEKRAGSGVAKIRIEDDGSYFQINQDGGTRRLEKAKVSLNDCLACSGCITSAETVLITQQSHEELKKVLDANKMAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTARSPQQVMGSLVKDFFAQQQHLTPDKIYHVTVMPCYDKKLEASRPDFFNQEHQTRDVDCVLTTGEVFRLLEEEGGSGGYLEHVFRHAARELFGIHVAEVTYKPLRNKDFQEVTLEKEGQVLLHFAMAYGFRNIQNLVQRLKRGRCPYHYVEVMACPSGCLNGGGQLQAPDRPSRELLQHVERLYGMVRAEAPEDAPGVQELYTHWLQGTDSECAGRLLHTQYHAVEKASTGLGIRW

SEQ ID NO: 870616 - protein, 258 aa, Homo sapiens [sequence omitted]

SEQ ID NO: 870617 - protein, 482 aa, Homo sapiens
GGSAAVMASPFSGALQLTDLDDFIGPSQECIKPVKVEKRAGSGVAKIRIEDDGSYFQINQDGGTRRLEKAKVSLNDCLACSGCITSAETVLITQQSHEELKKVLDANKMAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTARSPQQVMGSLVKDFFAQQQHLTPDKIYHVTVMPCYDKKLEASRPDFFNQEHQTRDVDCVLTTGEVFRLLEEEGVSLPDLEPAPLDSLCSGASAEEPTSHRGGGSGGYLEHVFRHAARELFGIHVAEVTYKPLRNKDFQEVTLEKEGQVLLHFAMAYGFRNIQNLVQRLKRGRCPYHYVEVMACPSGCLNGGGQLQAPDRPSRELLQHVERLYGMVRAEAPEDAPGVQELYTHWLQGTDSECAGRLLHTQYHAVEKASTGLGIRW

SEQ ID NO: 870618 - protein, 88 aa, Homo sapiens
GGSAAVMASPFSGALQLTDLDDFIGPSQECIKPVKVEKRAGSGVAKIRIEDDGSYFQINQVRHRRLLHHLSCPADPKHFSLLPPVTER

SEQ ID NO: 870619 - protein, 482 aa, Homo sapiens; identical to SEQ ID NO: 870617

SEQ ID NO: 870620 - protein, 373 aa, Homo sapiens
RLWKTGRLWKTGRLWKTGRLWKTGEAWKTGWKCWHKWPFLEKRLPSRGSHAQSPQVPRRCRLHAELRVVVGRTGMSTLECHHDLLYERARPQNVVLLPVGAGAAVRPRQPRVPPVTSGWICYAEKTHGSFILPHISTARSPQQVMGSLVKDFFAQQQHLTPDKIYHVTVMPCYDKKLEASRPDFFNQEHQTRDVDCVLTTGEVFRLLEEEGGSGGYLEHVFRHAARELFGIHVAEVTYKPLRNKDFQEVTLEKEGQVLLHFAMAYGFRNIQNLVQRLKRGRCPYHYVEVMACPSGCLNGGGQLQAPDRPSRELLQHVERLYGMVRAEAPEDAPGVQELYTHWLQGTDSECAGRLLHTQYHAVEKASTGLGIRW

SEQ ID NO: 870621 - protein, 290 aa, Homo sapiens
GGSAAVMASPFSGALQLTDLDDFIGPSQECIKPVKVEKRAGSGVAKIRIEDDGSYFQINQDGGTRRLEKAKVSLNDCLACSGCITSAETVLITQQSHEELKKVLDANKMAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTARSRAAALRNGVRLPQHPEPGAEAQTRALPLPLRGGHGLPLRLPERRGPAPGPRQAQQRAPPARGETVRHGPG

SEQ ID NO: 870622 - protein, 182 aa, Homo sapiens
GGSAAVMASPFSGALQLTDLDDFIGPSQECIKPVKVEKRAGSGVAKIRIEDDGSYFQINQDGGTRRLEKAKVSLNDCLACSGCITSAETVLITQQSHEELKKVLDANKMAAPSQQRLVVVSVSPQSRASLAARFQLNPTDTARKLTSFFKKIGVHFVFDTAFSRHFSLSRGCLRQSKTGSHP

SEQ ID NO: 870623 - protein, 120 aa, Homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTR

SEQ ID NO: 870624 - protein, 194 aa, Homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWAGLRATLPPTQEALPSSHSSPQQQG

SEQ ID NO: 870625 - protein, 266 aa, Homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWPGLKGKTLAPRSQRNATWPPPKDTRHGINTQKSQNGTKGTQQGGGELLKKTGKNPSAKWGQNPKRGGGPTQKGDQKGAPKMAKPKKSPVCGRNPQRG

SEQ ID NO: 870626 - protein, 194 aa, Homo sapiens; identical to SEQ ID NO: 870624

SEQ ID NO: 870627 - protein, 199 aa, Homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWVRSPRRGLQEQEELCFHMWGGKGGLCQSSL

SEQ ID NO: 870628 - protein, 199 aa, Homo sapiens; identical to SEQ ID NO: 870627

SEQ ID NO: 870629 - protein, 142 aa, Homo sapiens
PARKASPFLGVLLRHLEVCCPDPPERSLTRLAHCTWQLYQPSGLPRCVDTEYTPQPVLAYWKSDLIKLATLTLCHQSNLTCLIYHFHYCGSPPFRLCVCPSKMPLFHSACGSPMHLSKANSSSSFFLTPSLNIPALLSLVPL

SEQ ID NO: 870630 - protein, 599 aa, Homo sapiens
MHPIPSSFMIKAVSSFLTAEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVVRTIINSGFQNAVLSLCGFRAHKLKTKATFPPAAT

SEQ ID NO: 870631 - protein, 599 aa, Homo sapiens; identical to SEQ ID NO: 870630

SEQ ID NO: 870632 - protein, 599 aa, Homo sapiens; identical to SEQ ID NO: 870630

SEQ ID NO: 870633 - protein, 581 aa, Homo sapiens
MHPIPSSFMIKAVSSFLTAEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSR

SEQ ID NO: 870634 - protein, 599 aa, Homo sapiens; identical to SEQ ID NO: 870630

SEQ ID NO: 870635 - protein, 596 aa, Homo sapiens
MHPIPSSFMIKAVSSFLTAEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 870636 - protein, 581 aa, Homo sapiens; identical to SEQ ID NO: 870633

SEQ ID NO: 870637 - protein, 614 aa, Homo sapiens
MHPIPSSFMIKAVSSFLTAEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLEVRTTQKHETQISHHLAYPRKVPTQKSLGLPGHSLSWPCNFGHDSDLPLCSCRERNRLGHKMNCRPGVVAHACNLSTLGGEGGWIT

SEQ ID NO: 870638 - protein, 815 aa, Homo sapiens
ASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVVRTIINSGFQNAVLSLCGFRAHKLKTKATFPPAAT

SEQ ID NO: 870639 - protein, 615 aa, Homo sapiens
MACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVVRTIINSGFQNAVLSLCGFRAHKLKTKATFPPAAT

SEQ ID NO: 870640 - protein, 599 aa, Homo sapiens; identical to SEQ ID NO: 870630

SEQ ID NO: 870641 - protein, 599 aa, Homo sapiens; identical to SEQ ID NO: 870630

SEQ ID NO: 870642 - protein, 599 aa, Homo sapiens; identical to SEQ ID NO: 870630

SEQ ID NO: 870643 - protein, 661 aa, Homo sapiens
MHPIPSSFMIKAVSSFLTAEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 870644 - protein, 626 aa, Homo sapiens
MHPIPSSFMIKAVSSFLTAEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLEICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 870645 - protein, 599 aa, Homo sapiens; identical to SEQ ID NO: 870630

SEQ ID NO: 870646 - protein, 561 aa, Homo sapiens
MHPIPSSFMIKAVSSFLTAEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLEICCHRRSLQEDEEGFSRDSEAPTEEEESEALP

SEQ ID NO: 870647 - protein, 557 aa, Homo sapiens
LRYSKDQPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVVRTIINSGFQNAVLSLCGFRAHKLKTKATFPPAAT

SEQ ID NO: 870648 - protein, 192 aa, Homo sapiens
SLHPGDLYPFTRKPLFIIVDSSNSVAYKNFTNLFGQPLVCLLSPTAYPKALQDQSQRGSLFTLFLNNPLMAFLFVSGLSSMRRGLWEKCQEYLRKINRDIAQLLTHSRSIDQAFLQFFGDEFLRLLLTRFIFCSATMRMHKIFRETRNYPESYPQLPRDETVENPHLQKHILELASILDVRNVFFENTIDDY

SEQ ID NO: 870649 - protein, 2173 aa, Homo sapiens
CPYSGVLASKPSTPGYPNFRNLCPSYFDPGGLAMIGAWSHIHGSAPDAPGLRAAASQATLWQELQVEVKAHQGQVQRVLSSGRSLAASGHPQAQHIVEQCQELEGHWAELERACEARAQCLQQAVTFQQYFLDVSELEGWVEEKRPLVSSRDYGRDEAATLRLINKHQALQEELAIYWSSMEELDQTAQTLTGPEVPEQQRVVQERLREQLRALQELAATRDRELEGTLRLHEFLREAEDLQGWLASQKQAAKGGESLGEDPEHALHLCTKFAKFQHQVEMGSQRVAACRLLAESLLERGHSAGPMVRQRQQDLQTAWSELWELTQARGHALRDTETTLRVHRDLLEVLTQVQEKATSLPNNVARDLCGLEAQLRSHQGLERELVGTERQLQELLETAGRVQKLCPGPQAHAVQQRQQAVTQAWAVLQRRMEQRRAQLERARLLARFRTAVRDYASWAARVRQDLQVEESSQEPSSGPLKLSAHQWLRAELEAREKLWQQATQLGQQALLAAGTPTKEVQEELRALQDQRDQVYQTWARKQERLQAEQQEQLFLRECGRLEEILAAQEVSLKTSALGSSVEEVEQLIRKHEVFLKVLTAQDKKEAALRERLKTLRRPRVRDRLPILLQRRMRVKELAESRGHALHASLLMASFTQAATQAEDWIQAWAQQLKEPVPPGDLRDKLKPLLKHQAFEAEVQAHEEVMTSVAKKGEALLAQSHPRAGEVSQRLQGLRKHWEDLRQAMALRGQELEDRRNFLEFLQRVDLAEAWIQEKEVKMNVGDLGQDLEHCLQLRRRLREFRGNSAGDTVGDACIRSISDLSLQLKNRDPEEVKIICQRRSQLNNRWASFHGNLLRYQQQLEGALEIHVLSRELDNVTKRIQEKEALIQALDCGKDLESVQRLLRKHEELEREVHPIQAQVESLEREVGRLCQRSPEAAHGLRHRQQEVAESWWQLRSRAQKRREALDALHQAQKLQAMLQELLVSAQRLRAQMDTSPAPRSPVEARRMLEEHQECKAELDSWTDSISLARSTGQQLLTAGHPFSSDIRQVLAGLEQELSSLEGAWQEHQLQLQQALELQLFLSSVEKMERWLCSKEDSLASEGLWDPLAPMEPLLWKHKMLEWDLEVQAGKISALEATARGLHQGGHPEAQSALGRCQAMLLRKEALFRQAGTRRHRLEELRQLQAFLQDSQEVAAWLREKNLVALEEGLLDTAMLPAQLQKQQNFQAELDASMHQQQELQREGQRLLQGGHPASEAIQERLEELGALWGELQDNSQKKVAKLQKACEALRLRRSMEELENWLEPIEVELRAPTVGQALPGVGELLGTQRELEAAVDKKARQAEALLGQAQAFVREGHCLAQDVEEQARRLLQRFKSLREPLQERRTALEARSLLLKFFRDADEEMAWVQEKLPLAAAQDYGQSLSAVRHLQEQHQNLESEMSSHEALTRVVLGTGYKLVQAGHFAAHEVAARVQQLEKAMAHLRAEAARRRLLLQQAQEAQQFLTELLEAGSWLAERGHVLDSEDMGHSAEATQALLRRLEATKRDLEAFSPRIERLQQTAALLESRKNPESPKVLAQLQAVREAHAELLRRAEARGHGLQEQLQLHQLERETLLLDAWLTTKAATAESQDYGQDLEGVKVLEEKFDAFRKEVQSLGQAKVYALRKLAGTLERGAPRRYPHIQAQRSRIEAAWERLDQAIKARTENLAAAHEVHSFQQAAAELQGRMQEKTALMKGEDGGHSLSSVRTLQQQHRRLERELEAMEKEVARLQTEACRLGQLHPAAPGGLAKVQEAWATLQAKAQERGQWLAQAAQGHAFLGRCQELLAWAQERQELASSEELAEDVAGAEQLLGQHEELGQEIRECRLQAQDLRQEGQQLVDNSHFMSAEVTECLQELEGRLQELEEAWALRWQRCAESWGLQKLRQRLEQAEAWLACWEGLLLKPDYGHSVSDVELLLHRHQDLEKLLAAQEEKFAQMQKTEMEQELLLQPQELKPGRAGSSLTSFQWRPSGHQGLGAQLAETRDPQDAKGTPTMEGSLEFKQHLLPGGRQPSSSSWDSCRGTLQGSSLSLFLDERMAAEKVASIALLDLTGARCERLRGRHGRKHTFSLRLTSGAEILFAAPSEEQAESWWRALGSTAAQSLSPKLKAKPVSSLNECTTKDARPGCLLRSDP

SEQ ID NO: 870650 - protein, 107 aa, Homo sapiens
TARWGTSPVPVLRGTQHLGTTAMTIISGQEPARSTACGQQLAEVVELLQRHDLLEAQVSAHGAHVSHLAQQTAELDSSLGTSVEVLQAKARTLAQLQQSLVALVRAR

SEQ ID NO: 870651 - protein, 3674 aa, Homo sapiens
MAGQPHSPRELLGAAGHRSRRPSTELRVPPSPSLTMDSQYETGHIRKLQARHMQMQEKTFTKWINNVFQCGQAGIKIRNLYTELADGIHLLRLLELISGEALPPPSRGRLRVHFLENSSRALAFLRAKVPVPLIGPENIVDGDQTLILGLIWVIILRFQISHISLDKEEFGASAALLSTKEALLVWCQRKTASYTNVNITDFSRSWSDGLGFNALIHAHRPDLLDYGSLRPDRPLHNLAFAFLVAEQELGIAQLLDPEDVAAAQPDERSIMTYVSLYYHYCSRLHQGQTVQRRLTKILLQLQETELLQTQYEQLVADLLRWIAEKQMQLEARDFPDSLPAMRQLLAAFTIFRTQEKPPRLQQRGAAEALLFRLQTALQAQNRRPFLPHEGLGLAELSQCWAGLEWAEAARSQALQQRLLQLQRLETLARRFQRKAALRESFLKDAEQVLDQARAPPASLATVEAAVQRLGMLEAGILPQEGRFQALAEIADILRQEQYHSWADVARRQEEVTVRWQRLLQHLQGQRKQVADMQAVLSLLQEVEAASHQLEELQEPARSTACGQQLAEVVELLQRHDLLEAQVSAHGAHVSHLAQQTAELDSSLGTSVEVLQAKARTLAQLQQSLVALVRARRALLEQTLQRAEFLRNCEEEEAWLKECGQRVGNAALGRDLSQIAGALQKHKALEAEVHRHQAVCVDLVRRGRDLSARRPPTQPDPGERAEAVQGGWQLLQTRVVGRGARLQTALLVLQYFADAAEAASWLRERRSSLERASCGQDQAAAETLLRRHVRLERVLRAFAAELRRLEEQGRAASARASLFTVNSALSPPGESLRNPGPWSEASCHPGPGDAWKMALPAEPDPDFDPNTILQTQDHLSQDYESLRALAQLRRARLEEAMALFGFCSSCGELQLWLEKQTVLLQRVQPQADTLEVMQLKYENFLTALAVGKGLWAEVSSSAEQLRQRYPGNSTQIQRQQEELSQRWGQLEALKREKAVQLAHSVEVCSFLQECGPTQVQLRDVLLQLEALQPGSSEDTRHALQLAQKKTLVLERRVYFLQSVVVKVEEPGYAESQPLQGQVETLQGLLKQVQEQVAQRARRQAETQARQSFLQESQQLLLWAESVQAQLRSKEVSVDVASAQRLLREHQDLLEEIHLWQERLQQLDAQSQPMAALDCPDSQEVPNTLRVLGQQGQELKVLWEQRQQWLQEGLELQKFGREVDGFTATCANHQAWLHLDNLGEDVREALSLLQQHREFGRLLSTLGPRAEALRAHGEKLVQSQHPAAHTVREQLQSIQAQWTRLQGRSEQRRRQLLASLQLQEWKQDVAELMQWMEEKGLMAAHEPSGARRNILQTLKRHEAAESELLATRRHVEALQQVGRELLSRRPCGQEDIQTRLQGLRSKWEALNRKMTERGDELQQAGQQEQLLRQLQDAKEQLEQLEGALQSSETGQDLRSSQRLQKRHQQLESESRTLAAKMAALASMAHGMAASPAILEETQKHLRRLELLQGHLAIRGLQLQASVELHQFCHLSNMELSWVAEHMPHGSPTSYTECLNGAQSLHRKHKELQVEVKAHQGQVQRVLSSGRSLAASGHPQAQHIVEQCQELEGHWAELERACEARAQCLQQAVTFQQYFLDVSELEGWVEEKRPLVSSRDYGRDEAATLRLINKHQALQEELAIYWSSMEELDQTAQTLTGPEVPEQQRVVQERLREQLRALQELAATRDRELEGTLRLHEFLREAEDLQGWLASQKQAAKGGESLGEDPEHALHLCTKFAKFQHQVEMGSQRVAACRLLAESLLERGHSAGPMVRQRQQDLQTAWSELWELTQARGHALRDTETTLRVHRDLLEVLTQVQEKATSLPNNVARDLCGLEAQLRSHQGLERELVGTERQLQELLETAGRVQKLCPGPQAHAVQQRQQAVTQAWAVLQRRMEQRRAQLERARLLARFRTAVRDYASWAARVRQDLQVEESSQEPSSGPLKLSAHQWLRAELEAREKLWQQATQLGQQALLAAGTPTKEVQEELRALQDQRDQVYQTWARKQERLQAEQQEQLFLRECGRLEEILAAQEVSLKTSALGSSVEEVEQLIRKHEVFLKVLTAQDKKEAALRERLKTLRRPRVRDRLPILLQRRMRVKELAESRGHALHASLLMASFTQAATQAEDWIQAWAQQLKEPVPPGDLRDKLKPLLKHQAFEAEVQAHEEVMTSVAKKGEALLAQSHPRAGEVSQRLQGLRKHWEDLRQAMALRGQELEDRRNFLEFLQRVDLAEAWIQEKEVKMNVGDLGQDLEHCLQLRRRLREFRGNSAGDTVGDACIRSISDLSLQLKNRDPEEVKIICQRRSQLNNRWASFHGNLLRYQQQLEGALEIHVLSRELDNVTKRIQEKEALIQALDCGKDLESVQRLLRKHEELEREVHPIQAQVESLEREVGRLCQRSPEAAHGLRHRQQEVAESWWQLRSRAQKRREALDALHQAQKLQAMLQELLVSAQRLRAQMDTSPAPRSPVEARRMLEEHQECKAELDSWTDSISLARSTGQQLLTAGHPFSSDIRQVLAGLEQELSSLEGAWQEHQLQLQQALELQLFLSSVEKMERWLCSKEDSLASEGLWDPLAPMEPLLWKHKMLEWDLEVQAGKISALEATARGLHQGGHPEAQSALGRCQAMLLRKEALFRQAGTRRHRLEELRQLQAFLQDSQEVAAWLREKNLVALEEGLLDTAMLPAQLQKQQNFQAELDASMHQQQELQREGQRLLQGGHPASEAIQERLEELGALWGELQDNSQKKVAKLQKACEALRLRRSMEELENWLEPIEVELRAPTVGQALPGVGELLGTQRELEAAVDKKARQAEALLGQAQAFVREGHCLAQDVEEQARRLLQRFKSLREPLQERRTALEARSLLLKFFRDADEEMAWVQEKLPLAAAQDYGQSLSAVRHLQEQHQNLESEMSSHEALTRVVLGTGYKLVQAGHFAAHEVAARVQQLEKAMAHLRAEAARRRLLLQQAQEAQQFLTELLEAGSWLAERGHVLDSEDMGHSAEATQALLRRLEATKRDLEAFSPRIERLQQTAALLESRKNPESPKVLAQLQAVREAHAELLRRAEARGHGLQEQLQLHQLERETLLLDAWLTTKAATAESQDYGQDLEGVKVLEEKFDAFRKEVQSLGQAKVYALRKLAGTLERGAPRRYPHIQAQRSRIEAAWERLDQAIKARTENLAAAHEVHSFQQAAAELQGRMQEKTALMKGEDGGHSLSSVRTLQQQHRRLERELEAMEKEVARLQTEACRLGQLHPAAPGGLAKVQEAWATLQAKAQERGQWLAQAAQGHAFLGRCQELLAWAQERQELASSEELAEDVAGAEQLLGQHEELGQEIRECRLQAQDLRQEGQQLVDNSHFMSAEVTECLQELEGRLQELEEAWALRWQRCAESWGLQKLRQRLEQAEAWLACWEGLLLKPDYGHSVSDVELLLHRHQDLEKLLAAQEEKFAQMQKTEMEQELLLQPQELKPGRAGSSLTSFQWRPSGHQGLGAQLAETRDPQDAKGTPTMEGSLEFKQHLLPGGRQPSSSSWDSCRGTLQGSSLSLFLDERMAAEKVASIALLDLTGARCERLRGRHGRKHTFSLRLTSGAEILFAAPSEEQAESWWRALGSTAAQSLSPKLKAKPVSSLNECTTKDARPGCLLRSDP

SEQ ID NO: 870652 - protein, 232 aa, Homo sapiens
ELLGAAGHRSRRPSTELRVPPSPSLTMDSQYETGHIRKLQARHMQMQEKTFTKWINNVFQCGQVSIAAVTHSPPIPGPQLWPVGLRGELWGHLPEAKLRPELLLPKQLLWVVPLRSQDGRTGEAGLTPYLPLSPPQAGIKIRNLYTELADGIHLLRLLELISGEALPPPSRGRLRVHFLENSSRALAFLRAKVGPRERGLGWCWGRQLGQAELLGHLSCARPLGRTEELGPE

SEQ ID NO: 870653 - protein, 322 aa, Homo sapiens
MSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 870654 - protein, 322 aa, Homo sapiens; identical to SEQ ID NO: 870653

SEQ ID NO: 870655 - protein, 322 aa, Homo sapiens; identical to SEQ ID NO: 870653

SEQ ID NO: 870656 - protein, 322 aa, Homo sapiens; identical to SEQ ID NO: 870653

SEQ ID NO: 870657 - protein, 293 aa, Homo sapiens
MSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 870658 - protein, 311 aa, Homo sapiens
MSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFIWTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 870659 - protein, 581 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKEKILKIYSLSRFSKIRRGAVAHVFNPSTLGGRGWQINLSFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 870660 - protein, 322 aa, Homo sapiens; identical to SEQ ID NO: 870653

SEQ ID NO: 870661 - protein, 322 aa, Homo sapiens; identical to SEQ ID NO: 870653

SEQ ID NO: 870662 - protein, 322 aa, Homo sapiens; identical to SEQ ID NO: 870653

SEQ ID NO: 870663 - protein, 322 aa, Homo sapiens; identical to SEQ ID NO: 870653

SEQ ID NO: 870664 - protein, 163 aa, Homo sapiens
PWGNQFPKIQWEDLHNNSIPNTTFGEIIIGLWKSPMEDDNERPTGCSIEQAWCLYTPVIHLAQFLTSAVLIGLGYPVCNLMSYTLYSKILGPKPQGVYMGWLTASGSGARILGPMFISQVYAHWGPRWAFSLVCGIIVLTITLLGVVYKRLIALSVRYGRIQE

SEQ ID NO: 870665 - protein, 163 aa, Homo sapiens; identical to SEQ ID NO: 870664

SEQ ID NO: 870666 - protein, 158 aa, Homo sapiens
MLSCFPKNLHNNSIPNTTFGEIIIGLWKSPMEDDNERPTGCSIEQAWCLYTPVIHLAQFLTSAVLIGLGYPVCNLMSYTLYSKILGPKPQGVYMGWLTASGSGARILGPMFISQVYAHWGPRWAFSLVCGIIVLTITLLGVVYKRLIALSVRYGRIQE

SEQ ID NO: 870667 - protein, 371 aa, Homo sapiens
GRLRRRSFLIRGYRLGSDVGVGGMVGSAFSAVILLQGRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 870668 - protein, 148 aa, Homo sapiens
VPGLRALGGGGCERRHCGAGQRAPSAAGPVGRGMRKRTEPVALEHERCAAAGSSSSGSAAAALDADCRLKQNLRLTGPAAAEPRCAADAGMKRALGRRKGVWLRLRKILFCVLGLYIAIPFLIKLCPFIQTLATGTNTFTRALSCHGY

SEQ ID NO: 870669 - protein, 371 aa, Homo sapiens; identical to SEQ ID NO: 870667

SEQ ID NO: 870670 - protein, 371 aa, Homo sapiens; identical to SEQ ID NO: 870667

SEQ ID NO: 870671 - protein, 155 aa, Homo sapiens
ATCMSLASCLPLSSLFVYLETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 870672 - protein, 377 aa, Homo sapiens
GRLRRRSFLIRGYRLGSDVGVGGMVGSAFSAVILLQGRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILRPQQGPGSSPDPSMWSELV

SEQ ID NO: 870673 - protein, 526 aa, Homo sapiens
MYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGFLAQDSVPAEKRNTEMLDNLPSAGSQFPDFKHLGTFLVFEELVTFEDVLVDFSPEELSSLSAAQRNLYREVMLENYRNLVSLGHQFSKPDIISRLEEEESYAMETDSRHTVICQGESHDDPLEPHQGNQEKLLTPITMNDPKTLTPERSYGSDEFERSSNLSKQSKDPLGKDPQEGTAPGICTSPQSASQENKHNRCEFCKRTFSTQVALRRHERIHTGKKPYECKQCAEAFYLMPHLNRHQKTHSGRKTSGCNEGRKPSVQCANLCERVRIHSQEDYFECFQCGKAFLQNVHLLQHLKAHEAARVLPPGLSHSKTYLIRYQRKHDYVGERACQCCDCGRVFSRNSYLIQHYRTHTQERPYQCQLCGKCFGRPSYLTQHYQLHSQEKTVECDHC

SEQ ID NO: 870674 - protein, 91 aa, Homo sapiens
MSEGQALGGWVQPETRTKEEIIELLVLEQYLTIIPEKLKPWVRAKKPENCEKLVTLLENYKEMYQPEDDNNSDCDRDDEGPGAYESRSPML

SEQ ID NO: 870675 - protein, 1590 aa, Homo sapiens
CRSLGSCGRRGLGGAGDVHPGLVAPPGAGRHEGALGGCSCPRLRSTEVSFAFLIFRPSWRRLARGRGTEVQTLGGWVQPETRTKEEIIELLVLEQYLTIIPEKLKPWVRAKKPENCEKLVTLLENYKEMYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 870676 - protein, 1590 aa, Homo sapiens; identical to SEQ ID NO: 870675

SEQ ID NO: 870677 - protein, 1590 aa, Homo sapiens; identical to SEQ ID NO: 870675

SEQ ID NO: 870678 - protein, 1588 aa, Homo sapiens
MLPPKHLSATKPKKSWAPNLYELDSDLTKEPDVIIGEGPTDSEFFHQRFRNLIYVEFVGPRKTLIKLRNLCLDWLQPETRTKEEIIELLVLEQYLTIIPEKLKPWVRAKKPENCEKLVTLLENYKEMYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 870679 - protein, 1588 aa, Homo sapiens; identical to SEQ ID NO: 870678

SEQ ID NO: 870680 - protein, 1590 aa, Homo sapiens; identical to SEQ ID NO: 870675

SEQ ID NO: 870681 - protein, 1478 aa, Homo sapiens
MLPPKHLSATKPKKSWAPNLYELDSDLTKEPDVIIGEGPTDSEFFHQRFRNLIYVEFVGPRKTLIKLRNLCLDWLQPETRTKEEIIELLVLEQYLTIIPEKLKPWVRAKKPENCEKLVTLLENYKEMYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGQMGMLMSQMVQVLKTQKKELKSQREKLKSQREMPTSLTVWELKTQKKVKIKRFR

SEQ ID NO: 870682 - protein, 191 aa, Homo sapiens
MLPPKHLSATKPKKSWAPNLYELDSDLTKEPDVIIGEGPTDSEFFHQRFRNLIYVEFVGPRKTLIKLRNLCLDWLQPETRTKEEIIELLVLEQYLTIIPEKLKPWVRAKKPENCEKLVTLLENYKEMYQPEDDNNSDVTSDDDMTRNRRESSPPHSVHSFSDRDWDRRGRSRDMEPRDRWSHTRNPRSSES

SEQ ID NO: 870683 - protein, 126 aa, Homo sapiens
MADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLPDEEVDDMI

SEQ ID NO: 870684 - protein, 1590 aa, Homo sapiens; identical to SEQ ID NO: 870675

SEQ ID NO: 870685 - protein, 1590 aa, Homo sapiens; identical to SEQ ID NO: 870675

SEQ ID NO: 870686 - protein, 1588 aa, Homo sapiens; identical to SEQ ID NO: 870678

SEQ ID NO: 870687 - protein, 644 aa, Homo sapiens
LLLPIDCMCMQVRNAFKIFSQYLLNINYVPRHIDNIQDPCSYGVYTLVREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 870688 - protein, 1588 aa, Homo sapiens; identical to SEQ ID NO: 870678

SEQ ID NO: 870689 - protein, 207 aa, Homo sapiens
LFGQALPLYSLEWTARGCSWSPEPKMEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQDCHQGQRELKFLCMLR

SEQ ID NO: 870690 - protein, 230 aa, Homo sapiens
LFGQALPLYSLEWTARGCSWSPEPKMEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQGLASPLLRCPSQRLLDRVVRRYAEVADAGSIFMDHFTDG

SEQ ID NO: 870691 - protein, 67 aa, Homo sapiens
VVWPCRAVQSKPPDSNNSSITLRMTLYGRICASASAPKTCSIERVLRKTERFQKWLQAKRLTPDLVQ

SEQ ID NO: 870692 - protein, 118 aa, Homo sapiens
LGRPGGPAGGTGQLEHPPGARAASLLAATCGQHAWPPAADHVAFCPVPCQMAPSEPPGETRCGLASESPPPPAVGTALSREGDSGWAARLLPLRLQTLFAPRFLWSTRRLHTHFLYLS

SEQ ID NO: 870693 - protein, 1338 aa, Homo sapiens
RTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDGALGTARRNQVWFGLRVPPTACCGHSTQPRGGQRVGSKTASFAASDPVRS

SEQ ID NO: 870694 - protein, 1343 aa, Homo sapiens
RTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDPESEKPD

SEQ ID NO: 870695 - protein, 1338 aa, Homo sapiens; identical to SEQ ID NO: 870693

SEQ ID NO: 870696 - protein, 1322 aa, Homo sapiens
RTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDGALGTARRNQVWFGLRVPPTACCGHSTQPRGGQRVGSKTASFAASDPVRS

SEQ ID NO: 870697 - protein, 1402 aa, Homo sapiens
RTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSICLYLFFCILSPPGPWFSPPTPSLSSLPFIHFIGCLPHPIEVTYLISKWNPMSRSPGAAAASAYPQAPHSVLCMLMAGAWARKACAAAGLPSAPGTSAQKDWSPLHSFRHLIYLIFFFMLDVVFFSVAIVANIHVRCPQFQRQQKDNPNLLQMHSVCHACLDCEDMHIASLYGSKGHWRAWFLYQGQIPAPSTLHTHRPVPCMWKC

SEQ ID NO: 870698 - protein, 549 aa, Homo sapiens
RTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQGMSSRRPHKPLPVSCTGLLLCMTQPVCAPCPGPCRGLTLPCLPWRRAACGAVFLSLFSAESAQSKQPPGLSLPCYPTK

SEQ ID NO: 870699 - protein, 67 aa, Homo sapiens
VSLTALLFLCFFLQVEKSELAPTRGAVMEQGTSSSMTGNSFLLNPAFTRCCLASLPQNLLHPHPRLS

SEQ ID NO: 870700 - protein, 1386 aa, Homo sapiens
RTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDGALGTARRNQVWFGLRVPPTACCGHSTQPRGGQRVGSKTASFAASDPVRS

SEQ ID NO: 870701 - protein, 1295 aa, Homo sapiens
RTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDPESEKPD

SEQ ID NO: 870702 - protein, 1263 aa, Homo sapiens
RTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGSSTSSLAPGPEPGPQPALHVQAQVNNSNNKKGTFTDDLHKLVDEWTSKTVGAAQLKPTLNQLKQTQKLQDMEAQAGWAAPGEARAPQELGLSTLQIGR

SEQ ID NO: 870703 - protein, 1199 aa, Homo sapiens
RTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGSSTSSLAPGPEPGPQPALHVQAQILRVRSLTDPA

SEQ ID NO: 870704 - protein, 61 aa, Homo sapiens
EAGVAVGVEEESQQPVLDECLFVFFPLYSFAGWTVYHPTSERVTYKSSSKPRARFLSGPVS

SEQ ID NO: 870705 - protein, 271 aa, Homo sapiens
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 870706 - protein, 272 aa, Homo sapiens
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETLRNQGQVRGTSAASDE

SEQ ID NO: 870707 - protein, 284 aa, Homo sapiens
LLQKLGRMRLGPEMVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 870708 - protein, 157 aa, Homo sapiens
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPAVSITQ

SEQ ID NO: 870709 - protein, 271 aa, Homo sapiens; identical to SEQ ID NO: 870705

SEQ ID NO: 870710 - protein, 273 aa, Homo sapiens
MGDLLMEKCRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 870711 - protein, 271 aa, Homo sapiens; identical to SEQ ID NO: 870705

SEQ ID NO: 870712 - protein, 545 aa, Homo sapiens
MLLLHRAVVLRLQQACRLKSIPSRICIQACSTNDSFQPQRPSLTFSGDNSSTQGWRVMGTLLGLGAVLAYQDHRCRAAQESTHIYTKEEVSSHTSPETGIWVTLGSEVFDVTEFVDLHPGGPSKLMLAAGGPLEPFWALYAVHNQSHVRELLAQYKIGELNPEDKVAPTVETSDPYADDPVRHPALKVNSQRPFNAEPPPELLTENYITPNPIFFTRNHLPVPNLDPDTYRLHVVGAPGGQSLSLSLDDLHNFPRYEITVTLQCAGNRRSEMTQVKEVKGLEWRTGAISTARWAGARLCDVLAQAGHQLCETEAHVCFEGLDSDPTGTAYGASIPLARAMDPEAEVLLAYEMNGQPLPRDHGFPVRVVVPGVVGARHVKWLGRVSVQPEESYSHWQRRDYKGFSPSVDWETVDFDSAPSIQELPVQSAITEPRDGETVESGEVTIKGYAWSGGGRAVIRVDVSLDGGLTWQVAKLDGEEQRPRKAWAWRLWQLKAPVPAGQKELNIVCKAVDDGYNVQPDTVAPIWNLRGVLSNAWHRVHVYVSP

SEQ ID NO: 870713 - protein, 545 aa, Homo sapiens; identical to SEQ ID NO: 870712

SEQ ID NO: 870714 - protein, 545 aa, Homo sapiens; identical to SEQ ID NO: 870712

SEQ ID NO: 870715 - protein, 552 aa, Homo sapiens
MGERSATMLLLHRAVVLRLQQACRLKSIPSRICIQACSTNDSFQPQRPSLTFSGDNSSTQGWRVMGTLLGLGAVLAYQDHRCRAAQESTHIYTKEEVSSHTSPETGIWVTLGSEVFDVTEFVDLHPGGPSKLMLAAGGPLEPFWALYAVHNQSHVRELLAQYKIGELNPEDKVAPTVETSDPYADDPVRHPALKVNSQRPFNAEPPPELLTENYITPNPIFFTRNHLPVPNLDPDTYRLHVVGAPGGQSLSLSLDDLHNFPRYEITVTLQCAGNRRSEMTQVKEVKGLEWRTGAISTARWAGARLCDVLAQAGHQLCETEAHVCFEGLDSDPTGTAYGASIPLARAMDPEAEVLLAYEMNGQPLPRDHGFPVRVVVPGVVGARHVKWLGRVSVQPEESYSHWQRRDYKGFSPSVDWETVDFDSAPSIQELPVQSAITEPRDGETVESGEVTIKGYAWSGGGRAVIRVDVSLDGGLTWQVAKLDGEEQRPRKAWAWRLWQLKAPVPAGQKELNIVCKAVDDGYNVQPDTVAPIWNLRGVLSNAWHRVHVYVSP

SEQ ID NO: 870716 - protein, 545 aa, Homo sapiens; identical to SEQ ID NO: 870712

SEQ ID NO: 870717 - protein, 545 aa, Homo sapiens; identical to SEQ ID NO: 870712

SEQ ID NO: 870718 - protein, 355 aa, Homo sapiens
GRGVSALKGRWLLTENYITPNPIFFTRNHLPVPNLDPDTYRLHVVGAPGGQSLSLSLDDLHNFPRYEITVTLQCAGNRRSEMTQVKEVKGLEWRTGAISTARWAGARLCDVLAQAGHQLCETEAHVCFEGLDSDPTGTAYGASIPLARAMDPEAEVLLAYEMNGQPLPRDHGFPVRVVVPGVVGARHVKWLGRVSVQPEESYSHWQRRDYKGFSPSVDWETVDFDSAPSIQELPVQSAITEPRDGETVESGEVTIKGYAWSGGGRAVIRVDVSLDGGLTWQVAKLDGEEQRPRKAWAWRLWQLKAPVPAGQKELNIVCKAVDDGYNVQPDTVAPIWNLRGVLSNAWHRVHVYVSP

SEQ ID NO: 870719 - protein, 129 aa, Homo sapiens
MKILVALAVFFLVSTQLFAEEIGANDDLNYWSDWYDSDQIKEELPEPFEHLLQRIARRPKPQQFFGLMGKRDADSSIEKQVALLKALYGHGQISHKRHKTDSFVGLMGKRALNSVAYERSAMQNYERRR

SEQ ID NO: 870720 - protein, 111 aa, Homo sapiens
MKILVALAVFFLVSTQLFAEEIGANDDLNYWSDWYDSDQIKEELPEPFEHLLQRIARRPKPQQFFGLMGKRDADSSIEKQVALLKALYGHGQISHKMAYERSAMQNYERRR

SEQ ID NO: 870721 - protein, 114 aa, Homo sapiens
MKILVALAVFFLVSTQLFAEEIGANDDLNYWSDWYDSDQIKEELPEPFEHLLQRIARRPKPQQFFGLMGKRDAGHGQISHKRHKTDSFVGLMGKRALNSVAYERSAMQNYERRR

SEQ ID NO: 870722 - protein, 197 aa, Homo sapiens
SGGPDVMGIDELPSRKLSITQAKGEEAAELNIEQKVAWGECHVGLEAQGGWDKYRKALSRRKSALGPPSRRQLPRVRSDQRALGGTRETQHPAGLSVAKSNMKILVALAVFFLVSTQLFAEEIGANDDLNYWSDWYDSDQIKEELPEPFEHLLQRIARRPKPQQFFGLMGKRDAGHGQISHKMAYERSAMQNYERRR

SEQ ID NO: 870723 - protein, 217 aa, Homo sapiens
MREGRRQRHAREPAGDITVGGNTSTATTRRATKQKERHEGGHEGEGTTRGTEGRRAEEKRTSERDEVGDAGDEESGAEPGRGRREGGTRGTNMHARGRPKGRTKKKKRKNKRDTEGGSRKEEKEGKEELNGEAKGGADTEGDKRQEQETDHKKERRKGANEERARGQEETQAREEEEGAERRERRRRDEGKKTKNGRGKGKTEKQQQTTRDEARGAS

SEQ ID NO: 870724 - protein, 142 aa, Homo sapiens
TLSKRQPHPAGRATPLPHPTAASRLSAPRGTQGDRARCVTLGSQPTHLEAPMCHLTQERAAEAASRTAAPSPHPQDPEILLHGLQEVGGPGFGAEAGGVGGETAETPETPPSQGFSLVSQPQPSSCCSLACCGCKHFAEETA

SEQ ID NO: 870725 - protein, 140 aa, Homo sapiens
WDWLLIHQCLVVQENRNVCGSVPKEADTCNFRKYDLARRKYLHLKLFQNLKRIYRKMGKRHERPPHIKSNTSVLIVKLDARSYPRSNECSTGPAAQQDGRSRRRGCCSGLLRVWEKGAVCILCGPELGWVFEGSLEIQPL

SEQ ID NO: 870726 - protein, 112 aa, Homo sapiens
PIYDPALGGSPLTGNPTKRNLGCIISGFLPGLLEVAGWQPPDPVVFGVGRGRSPHLGCLTIWVKPAQKCMLGLPLLAKKAGPFLLSPGVSPPGRCWRSPWASLCCPDWEGVP

SEQ ID NO: 870727 - protein, 114 aa, Homo sapiens
GTTRGRHTCSSISPLLPPPAGIYRYSHAEGGSVMPRTLTLVLKGPGKASGIPRHIKVELFTTRGGLVFQHPSEYHTSPPALLELIRKKNRSLLQTGSLPESLCGLPSGQHLGLI

SEQ ID NO: 870728 - protein, 538 aa, Homo sapiens
MFFLYTDFFLSLVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 870729 - protein, 490 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQDPDIDAASAMMLLNTPPEIQAGFPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 870730 - protein, 490 aa, Homo sapiens; identical to SEQ ID NO: 870729

SEQ ID NO: 870731 - protein, 518 aa, Homo sapiens
MPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQREGVTKSLVLEEQKRKAGRSEMKLELLMRVSLCTSGPPIWPGSTFFKRNGALLQDPDIDAASAMMLLNTPPEIQAGFPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 870732 - protein, 468 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQVPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 870733 - protein, 468 aa, Homo sapiens; identical to SEQ ID NO: 870732

SEQ ID NO: 870734 - protein, 468 aa, Homo sapiens; identical to SEQ ID NO: 870732

SEQ ID NO: 870735 - protein, 332 aa, Homo sapiens
MLGFSSLNRGHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQVPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 870736 - protein, 233 aa, Homo sapiens [sequence omitted]

SEQ ID NO: 870737 - protein, 370 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQDPDIDAASAMMLLNTPPEIQAGFPPGVIQNGARVLSRGLFPGVRPLPITPIGVTAAMRQSVYTMIHLCDSSSQTYIVPELSATSIFLHLPLLGERRNSSVESIIIQRTCRNLSQQHKLQDQA

SEQ ID NO: 870738 - protein, 250 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQEK

SEQ ID NO: 870739 - protein, 242 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPHQVHPSGRAVPSSREMEPFSKMESYSCCPGWNAMA

SEQ ID NO: 870740 - protein, 468 aa, Homo sapiens; identical to SEQ ID NO: 870732

SEQ ID NO: 870741 - protein, 539 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQRDGVSPSWPGWSGTPDLVIHLPRLPKCWDYRREATEPGLVLNQITFPPTSTSGPPIWPGSTFFKRNGALLQDPDIDAASAMMLLNTPPEIQAGFPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 870742 - protein, 468 aa, Homo sapiens; identical to SEQ ID NO: 870732

SEQ ID NO: 870743 - protein, 366 aa, Homo sapiens
MPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQVPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 870744 - protein, 341 aa, Homo sapiens
SHVSADSNRGYSRGGRKVPNLQESRYREPGTESIGKGSLWCIDPEYRQNLIQALKKTPYHPHPHVFNTPPTCPQAYQSTSGPPIWPGSTFFKRNGALLQDPDIDAASAMMLLNTPPEIQAGFPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 870745 - protein, 186 aa, Homo sapiens [sequence omitted]

SEQ ID NO: 870746 - protein, 286 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQDGVLLLLPRLECNGVISAHCNLYSILGSSKILLPQPPK

SEQ ID NO: 870747 - protein, 289 aa, Homo sapiens
LGSNSADAGLWQAEGAILTHFTLCRKLQFGGRKAISRFQSGRHFPVGESAKGRGQFQEEGKACAQCTSFIPEARAVLDLVDQCPKQIQKGKFQVVAIEGLDATGKTTVTQSVADSLKAVLLKSPPSCIGQWRKIFDDEPTIIRRAFYSLGNYIVASEIAKESAKSPVIVDRYWHSTATYAIATEVSGGLQHLPPAHHPVYQWPEDLLKPDLILLLTVSPEERLQRLQGRGMEKTREEAELEANSVFRQKVEMSYQRMENPGCHVVDASPSREKVLQTVLSLIQNSFSEP

SEQ ID NO: 870748 - protein, 289 aa, Homo sapiens; identical to SEQ ID NO: 870747

SEQ ID NO: 870749 - protein, 449 aa, Homo sapiens
MAFARRLLRGPLSGPLLGRRGVCAGAMAPPRRFVLELPDCTLAHFALGADAPGDADAPDPRLAALLGPPERSYSLCVPVTPDAGCGARVRAARLHQRLLHQLRRGPFQRCQLLRLLCYCPGGQAGGAQQGFLLRDPLDDPDTRQALLELLGACQEAPRPHLGEFEADPRGQLWQRLWEVQDGRRLQVGCAQVVPVPEPPLHPVVPDLPSSVVFPDREAARAVLEECTSFIPEARAVLDLVDQCPKQIQKGKFQVVAIEGLDATGKTTVTQSVADSLKAVLLKSPPSCIGQWRKIFDDEPTIIRRAFYSLGNYIVASEIAKESAKSPVIVDRYWHSTATYAIATEVSGGLQHLPPAHHPVYQWPEDLLKPDLILLLTVSPEERLQRLQGRGMEKTREEAELEANSVFRQKVEMSYQRMENPGCHVVDASPSREKVLQTVLSLIQNSFSEP

SEQ ID NO: 870750 - protein, 160 aa, Homo sapiens
MVPKLFTSQICLLLLLGLMGVEGSLHARPPQFTRAQWFAIQHISLNPPRCTIAMRAINNYRWRCKNQNTFLRTTFANVVNVCGNQSIRCPHNRTLNNCHRSRFRVPLLHCDLINPGAQNISNCTYADRPGRRFYVVACDNRDPRDSPRYPVVPVHLDTTI

SEQ ID NO: 870751 - protein, 354 aa, Homo sapiens [sequence omitted]

SEQ ID NO: 870752 - protein, 333 aa, Homo sapiens
MNTTVMQGFNRSERCPRDTRIVQLVFPALYTVVFLTGILLNTLALWVFVHIPSSSTFIIYLKNTLVADLIMTLMLPFKILSDSHLAPWQLRAFVCRFSSVIFYETMYVGIVLLGLIAFDRFLKIIRPLRNIFLKKPVFAKTVSIFIWFFLFFISLPNMILSNKEATPSSVKKCASLKGPLGLKWHQMVNNICQFIFWTVFILMLVFYVVIAKKVYDSYRKSKSKDRKNNKKLEGKVFVVVAVFFVCFAPFHFARVPYTHSQTNNKTDCRLQNQLFIAKETTLFLAATNICMDPLIYIFLCKKFTEKLPCMQGRKTTASSQENHSSQTDNITLG

SEQ ID NO: 870753 - protein, 228 aa, Homo sapiens
MILVSQSCGLEGNLPSHYRLGSPDVASRRAPLGLACASPSFPPAESSRIFPPRLGFPLRGVRAPADCACAGPSRSRAFLCFSGLRAMAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKDKVLLYCPGESHTPGLK

SEQ ID NO: 870754 - protein, 171 aa, Homo sapiens
IPATAQVALEIPRDTYGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQEETSTLG

SEQ ID NO: 870755 - protein, 350 aa, Homo sapiens
MILVSQSCGLEGNLPSHYRLGSPDVASRRAPLGLACASPSFPPAESSRIFPPRLGFPLRGVRAPADCACAGPSRSRAFLCFSGLRAMAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHGMTSEI

SEQ ID NO: 870756 - protein, 350 aa, Homo sapiens; identical to SEQ ID NO: 870755

SEQ ID NO: 870757 - protein, 331 aa, Homo sapiens
MILVSQSCGLEGNLPSHYRLGSPDVASRRAPLGLACASPSFPPAESSRIFPPRLGFPLRGVRAPADCACAGPSRSRAFLCFSGLRAMAVTEASLLRQCPLLLPQNRSKTVYEGFISAQGRDFHLRIVLPEDLQLKNARLLCSWQLRTILSGYHRIVQQEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHGMTSEI

SEQ ID NO: 870758 - protein, 350 aa, Homo sapiens; identical to SEQ ID NO: 870755

SEQ ID NO: 870759 - protein, 350 aa, Homo sapiens; identical to SEQ ID NO: 870755

SEQ ID NO: 870760 - protein, 350 aa, Homo sapiens; identical to SEQ ID NO: 870755

SEQ ID NO: 870761 - protein, 273 aa, Homo sapiens
MILVSQSCGLEGNLPSHYRLGSPDVASRRAPLGLACASPSFPPAESSRIFPPRLGFPLRGVRAPADCACAGPSRSRAFLCFSGLRAMAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQEETSTLG

SEQ ID NO: 870762 - protein, 242 aa, Homo sapiens
MILVSQSCGLEGNLPSHYRLGSPDVASRRAPLGLACASPSFPPAESSRIFPPRLGFPLRGVRAPADCACAGPSRSRAFLCFSGLRAMAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDNFKIFFLLAATRNWKRQGIDSLLEPPEGAHLC

SEQ ID NO: 870763 - protein, 461 aa, Homo sapiens
MILVSQSCGLEGNLPSHYRLGSPDVASRRAPLGLACASPSFPPAESSRIFPPRLGFPLRGVRAPADCACAGPSRSRAFLCFSGLRAMAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 870764 - protein, 350 aa, Homo sapiens; identical to SEQ ID NO: 870755

SEQ ID NO: 870765 - protein, 291 aa, Homo sapiens
MILVSQSCGLEGNLPSHYRLGSPDVASRRAPLGLACASPSFPPAESSRIFPPRLGFPLRGVRAPADCACAGPSRSRAFLCFSGLRAMAVTEASLLRQCPLLLPQNRSKTVYEGFISAQEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHGMTSEI

SEQ ID NO: 870766 - protein, 350 aa, Homo sapiens; identical to SEQ ID NO: 870755

SEQ ID NO: 870767 - protein, 313 aa, Homo sapiens
MILVSQSCGLEGNLPSHYRLGSPDVASRRAPLGLACASPSFPPAESSRIFPPRLGFPLRGVRAPADCACAGPSRSRAFLCFSGLRAMAVTEASLLRQCPLLLPQNRSKTVYEGFISAQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 870768 - protein, 402 aa, Homo sapiens
TSALKARTPASVRAQCPPGGFGSAGGSRPRLLDTKVPHLLPFCSLSCLFCLTTAIMPRGQKSKLRAREKRRKAREETQGLKVAHATAAEKEECPSSSPVLGDTPTSSPAAGIPQKPQGAPPTTTAAAAVSCTESDEGAKCQGEENASFSQATTSTESSVKDPVAWEAGMLMHFILRKYKMREPIMKADMLKVVDEKYKDHFTEILNGASRRLELVFGLDLKEDNPSGHTYTLVSKLNLTNDGNLSNDWDFPRNGLLMPLLGVIFLKGNSATEEEIWKFMNVLGAYDGEEHLIYGEPRKFITQDLVQEKYLKYEQVPNSDPPRYQFLWGPRAYAETTKMKVLEFLAKMNGATPRDFPSHYEEALRDEEERAQVRSSVRARRRTTATTFRARSRAPFSRSSHPM

SEQ ID NO: 870769 - protein, 375 aa, Homo sapiens
LRISFALLQEPHHLPFCLHSCLLCLTTAIMPRGQKSKLRAREKRQRTRGQTQDLKVGQPTAAEKEESPSSSSSVLRDTASSSLAFGIPQEPQREPPTTSAAAAMSCTGSDKGDESQDEENASSSQASTSTERSLKDSLTRKTKMLVQFLLYKYKMKEPTTKAEMLKIISKKYKEHFPEIFRKVSQRTELVFGLALKEVNPTTHSYILVSMLGPNDGNQSSAWTLPRNGLLMPLLSVIFLNGNCAREEEIWEFLNMLGIYDGKRHLIFGEPRKLITQDLVQEKYLEYQQVPNSDPPRYQFLWGPRAHAETSKMKVLEFLAKVNDTTPNNFPLLYEEALRDEEERAGARPRVAARRGTTAMTSAYSRATSSSSSQPM

SEQ ID NO: 870770 - protein, 375 aa, Homo sapiens; identical to SEQ ID NO: 870769

SEQ ID NO: 870771 - protein, 375 aa, Homo sapiens; identical to SEQ ID NO: 870769

SEQ ID NO: 870772 - protein, 1352 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEKTTEGDGDG

SEQ ID NO: 870773 - protein, 958 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQDQESS

SEQ ID NO: 870774 - protein, 1429 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEKTTEGDGDG

SEQ ID NO: 870775 - protein, 1429 aa, Homo sapiens; identical to SEQ ID NO: 870774

SEQ ID NO: 870776 - protein, 1486 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQVRPGEGGCYMACLPHHSQHPRGAVLPQAEHGFWLVGQNRWGTLSSGTFSSLSLVSPQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEKTTEGDGDG

SEQ ID NO: 870777 - protein, 991 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQQLAQLLHPHKPRLQAPRGRPEPRRAQPGAPPPRARMRT

SEQ ID NO: 870778 - protein, 765 aa, Homo sapiens
RCKLRRRYSGVISYEASFAVRYQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEKTTEGDGDG

SEQ ID NO: 870779 - protein, 184 aa, Homo sapiens
MSPNSPRSVTPHSLSIGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEKTTEGDGDG

SEQ ID NO: 870780 - protein, 1376 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKKSDKRKKDK

SEQ ID NO: 870781 - protein, 130 aa, Homo sapiens
TPHAQRPRDFPPPCASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEKTTEGDGDG

SEQ ID NO: 870782 - protein, 178 aa, Homo sapiens
MESLPAPSSLLGTIRSVPQLSQICDPTFSLHRWKRGCFRHHTSEVPEAQERGWEPPSLNPGAAKQHPPGARRRRSWGPGKVGRPLFPQKRPPRLPRGKQRETKQVVMSRRRKGRGLLAPKGPRTSQKRRRQKGMGTVEGGDQSNPKSKKEKKKSDKRKKDKEKKEKKKKAKKGLNQRF

SEQ ID NO: 870783 - protein, 864 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTQKEPGKATSAQKTSEKDIHPESVWVSASNVTTDSEPPIELAAEPGRGHTGKSSPSKKGQKRRQSGNRKRQVKEMNTHNQRV

SEQ ID NO: 870784 - protein, 141 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKKDEPEEKTTEGDGDG

SEQ ID NO: 870785 - protein, 125 aa, Homo sapiens
PTPACPPLSHAPHLTITALLPIHIKTLACGEAGPRRKWTSSHDLTPLPQHRTLHIDVYSICIFLSDLLSFHRPHMPKGLGTSHHLAPQIQLGLTCASSRAARSLADPEALSSSRQFFWLCFLFFF

SEQ ID NO: 870786 - protein, 1429 aa, Homo sapiens; identical to SEQ ID NO: 870774

SEQ ID NO: 870787 - protein, 1391 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEKTTEGDGDG

SEQ ID NO: 870788 - protein, 1384 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEKTTEGDGDG

SEQ ID NO: 870789 - protein, 372 aa, Homo sapiens
MPPQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEKTTEGDGDG

SEQ ID NO: 870790 - protein, 1429 aa, Homo sapiens; identical to SEQ ID NO: 870774

SEQ ID NO: 870791 - protein, 337 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKKGRARREDDRRGWGRLKVEIKATQRARRRRRNPTREKKTKKKKKRRRKQKKASTKDSESPSQKKKKKKKKTAEQTV

SEQ ID NO: 870792 - protein, 958 aa, Homo sapiens; identical to SEQ ID NO: 870773

SEQ ID NO: 870793 - protein, 47 aa, Homo sapiens
QAAFLTAGHDSGWVMAVGWGGGSLFHNGLLQSLLSGYMTPGLTPANS

SEQ ID NO: 870794 - protein, 87 aa, Homo sapiens
AEECLPGTESSRLPAAQCSPSPYYLPGLAGGLGAGWVWRAGAQSGLFFLNRPLPSSWLWPFTSIGQWFSKCGSLASSIRDMLNMQIL

SEQ ID NO: 870795 - protein, 36 aa, Homo sapiens
MEAGPPFLALSGGALAATWDGGDRDPPQLGLILSLL

SEQ ID NO: 870796 - protein, 131 aa, Homo sapiens
RTGISNSLELGPLAPSLFSPAGTQDALVHSRDGDRRVQRAWVGRRAPVSSRPLTLGYQTVSLQPHPRRRFPEGGVGGAPDFQKASYLAGVWGGHCYSEKNQDVPFSPPSVLTSAPARSPLLGGKWKKRRYF

SEQ ID NO: 870797 - protein, 917 aa, Homo sapiens
MAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGAKISERIQGHTGAVTCIWMNEQCSSIITGGEDRQIIFWKLQY

SEQ ID NO: 870798 - protein, 394 aa, Homo sapiens
HAYATRSHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGAKISERIQGHTGAVTCIWMNEQCSSIITGGEDRQIIFWKLQY

SEQ ID NO: 870799 - protein, 821 aa, Homo sapiens
MAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPGRYYPF

SEQ ID NO: 870800 - protein, 821 aa, Homo sapiens; identical to SEQ ID NO: 870799

SEQ ID NO: 870801 - protein, 948 aa, Homo sapiens
MAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGANDQGAVYPGGETDSIICNGDKAFSRNYDLLDFSNFTAVCRLLSTRMVGSLGEPDSEGGRSSDEVNILPAAHT

SEQ ID NO: 870802 - protein, 365 aa, Homo sapiens
MLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGAKISERIQGHTGAVTCIWMNEQCSSIITGGEDRQIIFWKLQY

SEQ ID NO: 870803 - protein, 821 aa, Homo sapiens; identical to SEQ ID NO: 870799

SEQ ID NO: 870804 - protein, 673 aa, Homo sapiens
EFASMAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESFYQEMPLS

SEQ ID NO: 870805 - protein, 821 aa, Homo sapiens; identical to SEQ ID NO: 870799

SEQ ID NO: 870806 - protein, 132 aa, Homo sapiens
IFGILCTPCVHSPASQVSGGGIPTPVRGLGQRSRAIRKRESHSEPGPVGAGRPGHPGLGRLPSCTGAPATHPEGEAVIWLYGGARAVSLWGAGAVLRCFLPMGFWCRMSENQEQEVRVWSAENRWVKVGEGI

SEQ ID NO: 870807 - protein, 391 aa, Homo sapiens
IFGILCTPCVHSPASQVSGGGIPTPVRGLGQRSRAIRKRESHSEPGPVGAGRPGHPGLGRLPSCTGAPATHPEGEAVIWLYGGARAVSLWGAGAVLRSQPGSFVGSTYWLKSVFISRCFLPMGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 870808 - protein, 323 aa, Homo sapiens
VGLSVSSGTRDGGIALHPREGLSYHPGLRSQPGSFVGSTYWLKSVFISRCFLPMGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 870809 - protein, 303 aa, Homo sapiens
RAWGWAKFRATEGAGGMIDWMEGAGAVLRCFLPMGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 870810 - protein, 262 aa, Homo sapiens
MVCREQEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 870811 - protein, 371 aa, Homo sapiens
IFGILCTPCVHSPASQVSGGGIPTPVRGLGQRSRAIRKRESHSEPGPVGAGRPGHPGLGRLPSCTGAPATHPEGEAVIWLYGGARAVSLWGAGAVLRCFLPMGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 870812 - protein, 371 aa, Homo sapiens; identical to SEQ ID NO: 870811

SEQ ID NO: 870813 - protein, 371 aa, Homo sapiens; identical to SEQ ID NO: 870811

SEQ ID NO: 870814 - protein, 371 aa, Homo sapiens; identical to SEQ ID NO: 870811

SEQ ID NO: 870815 - protein, 397 aa, Homo sapiens
IFGILCTPCVHSPASQVSGGGIPTPVRGLGQRSRAIRKRESHSEPGPVGAGRPGHPGLGRLPSCTGAPATHPEGEAVIWLYGGARAVSLWGAGAVLRCFLPMGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLGLTQVGLGTGQVCGRLGCLVSSSHLCLG

SEQ ID NO: 870816 - protein, 290 aa, Homo sapiens
FAVPHPAPACTLRRPKCFLPMGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 870817 - protein, 371 aa, Homo sapiens; identical to SEQ ID NO: 870811

SEQ ID NO: 870818 - protein, 371 aa, Homo sapiens; identical to SEQ ID NO: 870811

SEQ ID NO: 870819 - protein, 145 aa, Homo sapiens
IFGILCTPCVHSPASQVSGGGIPTPVRGLGQRSRAIRKRESHSEPGPVGAGRPGHPGLGRLPSCTGAPATHPEGEAVIWLYGGARAVSLWGAGAVLRSQPGSFVGSTYWLKSVFISRCFLPMGFWCRMSENQEQEVRVWSAENRR

SEQ ID NO: 870820 - protein, 273 aa, Homo sapiens
MRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 870821 - protein, 297 aa, Homo sapiens
GRRVRAPDPAATQRRRPPRLEAQAMRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 870822 - protein, 273 aa, Homo sapiens; identical to SEQ ID NO: 870820

SEQ ID NO: 870823 - protein, 273 aa, Homo sapiens; identical to SEQ ID NO: 870820

SEQ ID NO: 870824 - protein, 217 aa, Homo sapiens
AARARPGSGAVGCVLSGLTGTLSPSRSCSVCTSPSSPPATGTGPAAPTAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 870825 - protein, 243 aa, Homo sapiens
GRRVRAPDPAATQRRRPPRLEAQAMRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 870826 - protein, 273 aa, Homo sapiens; identical to SEQ ID NO: 870820

SEQ ID NO: 870827 - protein, 257 aa, Homo sapiens
MRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSLSKDTAFPRPAHQT

SEQ ID NO: 870828 - protein, 158 aa, Homo sapiens [sequence omitted]

SEQ ID NO: 870829 - protein, 86 aa, Homo sapiens
EPPCTKLALHGCKGGSCGQARQVGLRRCLQAASGPEAPARARVHLQSQDTAAATMATPGLQQHQVWQGWPRRGRERTGRAPHSPHS

SEQ ID NO: 870830 - protein, 122 aa, Homo sapiens
MEKEFTHRGGRAKMDKRALDHTIGEEQTESPATPIIRERGPFLNDAPRKYAAEADRTLDADTPCWRNGKSHENGPNHAEGDPTSDEKGRNSNQFCSMGGGTVVRKQGIMSGGQKDMVTDQYR

SEQ ID NO: 870831 - protein, 273 aa, Homo sapiens; identical to SEQ ID NO: 870820

SEQ ID NO: 870832 - protein, 307 aa, Homo sapiens
MRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSWSRSHLGVTERKARQGLPPLPPPLPREAPQTLAWDGLGSSL

SEQ ID NO: 870833 - protein, 273 aa, Homo sapiens; identical to SEQ ID NO: 870820

SEQ ID NO: 870834 - protein, 133 aa, Homo sapiens
TKLALHGCKGGSCGQARQVGLRRCLQAASGPEAPARARVHLQSQDTAAATMATPGLQQHQQPPGPGRHRWPPPPGGAAPAPVRGMTDSPPPGHPEEKATPPGGTGHEGLSGGAADVASGVGSGRHRARLPARP

SEQ ID NO: 870835 - protein, 79 aa, Homo sapiens
RRRPGTPSPLGLDAPTVGDQIGGGTHRPGHCLCSMRSVAGPSCCGLSPGQHRKAQAGKRLCSDPSVPSLEEKTLGGMLG

SEQ ID NO: 870836 - protein, 110 aa, Homo sapiens
LLKLLLHLCSWQNFYLSSPKYTLYFPVHIVSIFFPNRSIFLSFSFLLWLSFNFTSVVAFFTKSSPLTQKAVNPTSMSLSSRAFNVHITHQDMSFFQQARTDGLMCMWHMQ

SEQ ID NO: 870837 - protein, 261 aa, Homo sapiens
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 870838 - protein, 261 aa, Homo sapiens; identical to SEQ ID NO: 870837

SEQ ID NO: 870839 - protein, 261 aa, Homo sapiens; identical to SEQ ID NO: 870837

SEQ ID NO: 870840 - protein, 261 aa, Homo sapiens; identical to SEQ ID NO: 870837

SEQ ID NO: 870841 - protein, 261 aa, Homo sapiens; identical to SEQ ID NO: 870837

SEQ ID NO: 870842 - protein, 242 aa, Homo sapiens
RYQRLSRMKDHGEDLRPRRLPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 870843 - protein, 160 aa, Homo sapiens
MELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 870844 - protein, 160 aa, Homo sapiens; identical to SEQ ID NO: 870843

SEQ ID NO: 870845 - protein, 179 aa, Homo sapiens
PVPETEQNVKIMGKILDHGEDFPASEIHGSPFDRVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 870846 - protein, 261 aa, Homo sapiens; identical to SEQ ID NO: 870837

SEQ ID NO: 870847 - protein, 261 aa, Homo sapiens; identical to SEQ ID NO: 870837

SEQ ID NO: 870848 - protein, 271 aa, Homo sapiens
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKRSCKKAVCDFPGFGGGREGRVNLLAVSPLWNIRG

SEQ ID NO: 870849 - protein, 237 aa, Homo sapiens
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGR

SEQ ID NO: 870850 - protein, 154 aa, Homo sapiens
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVLPEG

SEQ ID NO: 870851 - protein, 261 aa, Homo sapiens; identical to SEQ ID NO: 870837

SEQ ID NO: 870852 - protein, 266 aa, Homo sapiens
MQTGDMAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 870853 - protein, 219 aa, Homo sapiens
MPTPLEVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 870854 - protein, 258 aa, Homo sapiens
MAAAACTPRAPFPWIRSLSTRGPLGRGISPKSPWNTHLLSSIRPQVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 870855 - protein, 261 aa, Homo sapiens; identical to SEQ ID NO: 870837

SEQ ID NO: 870856 - protein, 169 aa, Homo sapiens
SLSRGSQRCAIPTRVTCHHRRFDRVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 870857 - protein, 108 aa, Homo sapiens [sequence omitted]

SEQ ID NO: 870858 - protein, 261 aa, Homo sapiens
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAENPPV

SEQ ID NO: 870859 - protein, 216 aa, Homo sapiens
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQLRSMLLVIALSIGGT

SEQ ID NO: 870860 - protein, 116 aa, Homo sapiens
PSTVHVNFNFSTTSLELGIVSVVDTASCPRIYFPLLPLITDLMSFTWIAAGHAQPNHRQDDVAESNMHHFWVMTLGSMLLRRYASQTRGGARVPNFALLVESLFTISLGRRFYNVR

SEQ ID NO: 870861 - protein, 244 aa, Homo sapiens
CIQAKAGPPVMLRVPEPRPGEAKAEGAAPPTPSKPLTSFLIQDILRDGAQRQGGRTSSQRQRDPEPEPEPEPEGGRSRAGAQNDQLSTGPRAAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 870862 - protein, 201 aa, Homo sapiens
CIQAKAGPPDRCSGFRSRGPGRRKRRGPRRRPRPSRSRPSSSRTSCGTAPPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 870863 - protein, 175 aa, Homo sapiens
CIQAKAGPPDDAQGSGAAARGGETPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 870864 - protein, 104 aa, Homo sapiens
PAPPSNLCFSRVPPPPSVGPGLCPSPQTLHPLRIGPRPAGGRGPRALTSLAEGGGRLEEGVTGPRLSTSESSLPGLVLLWHRRRGRERGGRAPGAKAGGWPWKG

SEQ ID NO: 870865 - protein, 405 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGSSEPN

SEQ ID NO: 870866 - protein, 405 aa, Homo sapiens; identical to SEQ ID NO: 870865

SEQ ID NO: 870867 - protein, 446 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGKDPTPSMLGLCGSLASIPSCKSLASFKSNECLVSDSPEGSPALSPS

SEQ ID NO: 870868 - protein, 381 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKGKDPTPSMLGLCGSLASIPSCKSLASFKSNECLVSDSPEGSPALSPS

SEQ ID NO: 870869 - protein, 405 aa, Homo sapiens; identical to SEQ ID NO: 870865

SEQ ID NO: 870870 - protein, 338 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHTPLPRVRLPKIR

SEQ ID NO: 870871 - protein, 340 aa, Homo sapiens
HASPTRSTTRPISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGKDPTPSMLGLCGSLASIPSCKSLASFKSNECLVSDSPEGSPALSPS

SEQ ID NO: 870872 - protein, 506 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRKAPARWGLGLRAGRPGEEGLPLPAHQLSLCRRHSFMSTEPLSAEASLSSDSQRLGEGTRDEEPWGPIETEFRQAGLELLTSSDSPTLASQSAGITGKDPTPSMLGLCGSLASIPSCKSLASFKSNECLVSDSPEGSPALSPS

SEQ ID NO: 870873 - protein, 405 aa, Homo sapiens; identical to SEQ ID NO: 870865

SEQ ID NO: 870874 - protein, 446 aa, Homo sapiens; identical to SEQ ID NO: 870867

SEQ ID NO: 870875 - protein, 478 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRKAPARWGLGLRAGRPGEEGLPLPAHQLSLCRRHSFMSTEPLSAEASLSSDSQRLGEGTRDEEPWGPIGKDPTPSMLGLCGSLASIPSCKSLASFKSNECLVSDSPEGSPALSPS

SEQ ID NO: 870876 - protein, 433 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIETEFRQAGLELLTSSDSPTLASQSAGITGSSEPN

SEQ ID NO: 870877 - protein, 478 aa, Homo sapiens; identical to SEQ ID NO: 870875

SEQ ID NO: 870878 - protein, 383 aa, Homo sapiens
MKDLGNPVLDEEGVAQREESAQGTPILGDGATGASPRLKGERGSRPACRSGRRIGLPSGWGGSKPTIAALGGGGALQGPAASSGPLPPHRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGKDPTPSMLGLCGSLASIPSCKSLASFKSNECLVSDSPEGSPALSPS

SEQ ID NO: 870879 - protein, 555 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFAGRPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRVEEVNWASWEQTLPTLCEDPSGAGVPRTLENPVLASPPKEDEDGASEENYVPVQLLQSN

SEQ ID NO: 870880 - protein, 764 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRVEEVNWASWEQTLPTLCEDPSGAGVPRTLENPVLASPPKEDEDGASEENYVPVQLLQSN

SEQ ID NO: 870881 - protein, 742 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFSVPGPAHSGVPGAVFPGHRVVPAPACVCAGAGLAEPALLYTWLPAHRHLQCHDPEALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRVEEVNWASWEQTLPTLCEDPSGAGVPRTLENPVLASPPKEDEDGASEENYVPVQLLQSN

SEQ ID NO: 870882 - protein, 719 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRNSREPCPGFPSQGG

SEQ ID NO: 870883 - protein, 564 aa, Homo sapiens
GLCTCYHLHKRSYCADGGTIKPDDQRWVMENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRVEEVNWASWEQTLPTLCEDPSGAGVPRTLENPVLASPPKEDEDGASEENYVPVQLLQSN

SEQ ID NO: 870884 - protein, 175 aa, Homo sapiens [sequence omitted]

SEQ ID NO: 870885 - protein, 122 aa, Homo sapiens
LTGQGSKWVAQNPAEKKPVLLRASVSTRASLHSLPIWGATPLSGVGGEAVKAGKPQSCSVALRVEEVNWASWEQTLPTLCEDPSGAGVPRTLENPVLASPPKEDEDGASEENYVPVQLLQSN

SEQ ID NO: 870886 - protein, 680 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQGGGGELGFMGADAAYAV

SEQ ID NO: 870887 - protein, 546 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKGGGGELGFMGADAAYAV

SEQ ID NO: 870888 - protein, 742 aa, Homo sapiens
MGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 870889 - protein, 742 aa, Homo sapiens; identical to SEQ ID NO: 870888

SEQ ID NO: 870890 - protein, 742 aa, Homo sapiens; identical to SEQ ID NO: 870888

SEQ ID NO: 870891 - protein, 323 aa, Homo sapiens
MISPVHPEADAHHGAPATGCVGPHLLLGSGECREDPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHRDEIQYIFGEPFATPLRATGPKTGQSLKAMTAYWTNFAKTGDPNMGDSAVPTHWEPYTTENSGYLEITKKMGSSSMKRSLRTNFLRYWTLTYLALPTVTDQEASSMPSTGDSEATPISPDRQLRVCPRPCNG

SEQ ID NO: 870892 - protein, 91 aa, Homo sapiens
DPNMGDSAVPTHWEPYTTENSGYLEITKKMGSSSMKRSLRTNFLRYWTLTYLALPTVTDQEASSMPSTGDSEATPISPDRQLRVCPRPCNG

SEQ ID NO: 870893 - protein, 742 aa, Homo sapiens; identical to SEQ ID NO: 870888

SEQ ID NO: 870894 - protein, 742 aa, Homo sapiens; identical to SEQ ID NO: 870888

SEQ ID NO: 870895 - protein, 598 aa, Homo sapiens
MGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPPRAAHG

SEQ ID NO: 870896 - protein, 649 aa, Homo sapiens
MGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPCRPRVTPGPPLCPPRVTLRLPLCPPQMTPRKLRCLQSLGFSVP

SEQ ID NO: 870897 - protein, 107 aa, Homo sapiens [sequence omitted]

SEQ ID NO: 870898 - protein, 106 aa, Homo sapiens
RWYPGTLIAAVEARSKRPSRRLLLPPLASPLHQQPKGVAPLTNPGWRRRRARGGRGHNLVLFRKDVDDATLSRLELERKIESLMDEIEFLKKLHEEVSGPGIRGGF

SEQ ID NO: 870899 - protein, 146 aa, Homo sapiens
MDEIEFLKKLHEEELRDLQVSVESQQVQQVEVEATVKPELTAALRDIRAQYESIAAKNLQEAEEWYKSKYADLSDAANRNHEALRQAKQEMNESRRQIQSLTCEVDGLRGTNEALLRQLRELEEQFALEAGGYQAGLRGSRRSCDS

SEQ ID NO: 870900 - protein, 188 aa, Homo sapiens
SLGYPHFSVRGPVRRCQPEPRGPAPGQAGDERVPTPDPESNVRGGRAARHERGAAQAVERAGGAVRPGGGGLPGGAARLEEELRQLKEEMARHLREYQELLNVKMALDIEIATYRKLLEGEESRISVPVHSFASLNIKTTVPEVEPPQDSHSRKTVLIKTIETRNGEVVTESQKEQRSELDKSSAHSY

SEQ ID NO: 870901 - protein, 146 aa, Homo sapiens; identical to SEQ ID NO: 870899

SEQ ID NO: 870902 - protein, 186 aa, Homo sapiens
MVGGGDAQGEDAEHNLVLFRKDVDDATLSRLELERKIESLMDEIEFLKKLHEEELRDLQVSVESQQVQQVEVEATVKPELTAALRDIRAQYESIAAKNLQEAEEWYKSKYADLSDAANRNHEALRQAKQEMNESRRQIQSLTCEVDGLRGTNEALLRQLRELEEQFALEAGGYQAGLRGSRRSCDS

SEQ ID NO: 870903 - protein, 91 aa, Homo sapiens
EMNPVPQMEMLKSPVFCVAQAGSCRPELFLFGHLVSSPGVMATVAEPRKPRRNQRMETHGSNGKSSDPGFPKEHWSRKMLCEKVFPGRRNL

SEQ ID NO: 870904 - protein, 264 aa, Homo sapiens
MEALPPVRSSLLGNLLQVTRLSVLLVQNRDHLYNFLLLKINLFNHWVSGLAQEARGSCNWQAHLPLGAAACPLGQALRAGLALIQVPVWLVLQGPRLMWAGMWGSTKGLGLALLSAWEQLGLSVAIWTDLFLSCLHGLMLVALLLVVVTWRVCQKSHCFRLGRQLSKALQVNCVVRKLLVQLRRLYWWVETMTALTSWHLAYLITWTTCLASHLLQAAFEHTTQLAEAQEVEPQEVSGSSLLPSLSASSDSESGTVLPEQETPR

SEQ ID NO: 870905 - protein, 240 aa, Homo sapiens
MLVQNRDHLYNFLLLKINLFNHWVSGLAQEARGSCNWQAHLPLGAAACPLGQALRAGLALIQVPVWLVLQGPRLMWAGMWGSTKGLGLALLSAWEQLGLSVAIWTDLFLSCLHGLMLVALLLVVVTWRVCQKSHCFRLGRQLSKALQVNCVVRKLLVQLRRLYWWVETMTALTSWHLAYLITWTTCLASHLLQAAFEHTTQLAEAQEVEPQEVSGSSLLPSLSASSDSESGTVLPEQETP

SEQ ID NO: 870906 - protein, 116 aa, Homo sapiens
TAAVLAVSAVCLERSCGGIRTSCLAPEVPSSLLSPLSAFTAVSCNVGGLHLGLQGPWESSRTPRPCLNCAINFQSYHEPTSPHRASVATMWASPVQTTEHSTMTGHSYKSRDHQSC

SEQ ID NO: 870907 - protein, 163 aa, Homo sapiens
APKLFCLILDMTSGHAAEVQEQHSSKTVAARLRLSVTAMTGFTRAEFGTASAKTKRKQEKGPKAKMKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 870908 - protein, 104 aa, Homo sapiens
MKLMVLVFTIGLTLLLGVQAMPANRLSCYRKILKDHNCHNLPEGVADLTQIDVNVQDHFWDGKGCEMICYCNFSELLCCPKVRKWYHKVYCLEMYAEQLLATSS

SEQ ID NO: 870909 - protein, 121 aa, Homo sapiens
IPGLQEFGTRARAIRKEKGPKAKMKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 870910 - protein, 98 aa, Homo sapiens
MKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 870911 - protein, 134 aa, Homo sapiens
SRASLWGPVGLKGWAGSGDGHLAALVGAREPTLLPSVLSLLLLCCTSWRVSGDLERHLCVVGEGGPRMHQTQGRAISDVSYLIPATSLHRGSHHHIVGDDVGPGDPLAPKGQAGALCCSPVAFRPHTLGFFCNA

SEQ ID NO: 870912 - protein, 263 aa, Homo sapiens
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAVDGCIHRAAGPLLTDECRTLQSCKTGKAKITGGYRLPAKCESPTRPQLWAQTGRPCVTGTSGVRPPQECWGTPQGALLNLKGQDPAPTPHT

SEQ ID NO: 870913 - protein, 325 aa, Homo sapiens
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAANSSLLGGGGVDGCIHRAAGPLLTDECRTLQSCKTGKAKITGGYRLPAKYVIHTVGPIAYGEPSASQAAELRSCYLSSLDLLLEHRLRSVAFPCISTGVFGYPCEAAAEIVLATLREWLEQHKDKVDRLIICVFLEKDEDIYRSRLPHYFPVA

SEQ ID NO: 870914 - protein, 334 aa, Homo sapiens
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAANSSLLGGGGVDGCIHRAAGPLLTDECRTLQSCKTGKAKITGGYRLPAKYVIHTVGPIAYGEPSASQAAELRSCYLSSLDLLLEHRLRSVAFPCISTGVFGYPCEAAAEIVLATLREWLEQHKDKVDRLIICVFLEKDEDIYRSRLPHYFPVDPPSGPRSQL

SEQ ID NO: 870915 - protein, 265 aa, Homo sapiens
TALTYGEAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAANSSLLGGGGVDGCIHRAAGPLLTDECRTLQSCKTGKAKITGGYRLPAKYVIHTVGPIAYGEPSASQAAELRSCYLSSLDLLLEHRLRSVAFPCISTGVFGYPCEAAAEIVLATLREWLEQHKDKVDRLIICVFLEKDEDIYRSRLPHYFPVA

SEQ ID NO: 870916 - protein, 276 aa, Homo sapiens
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAANSSLLGGGGVDGCIHRAAGPLLTDECRTLQSCKTGKAKITGGYRLPAKYVIHTVGPIAYGEPSASQAAELRSCYLSSLDLLLEHRLRSVVRDGPRGRAGGGAQ

SEQ ID NO: 870917 - protein, 163 aa, Homo sapiens
MCCTWAADSGANSSLLGGGGVDGCIHRAAGPLLTDECRTLQSCKTGKAKITGGYRLPAKYVIHTVGPIAYGEPSASQAAELRSCYLSSLDLLLEHRLRSVAFPCISTGVFGYPCEAAAEIVLATLREWLEQHKDKVDRLIICVFLEKDEDIYRSRLPHYFPVA

SEQ ID NO: 870918 - protein, 174 aa, Homo sapiens
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAGA

SEQ ID NO: 870919 - protein, 105 aa, Homo sapiens
PHYFPVGTCPAPPHGPPLPRSTLGAGSHCPLPSSLRLPQPTLTGTGKQGLAPCGGPGPRLTRPLTPAHPQAGRETTGQPGRSGTPIDTSDSALPSDPPSGPRSQL

SEQ ID NO: 870920 - protein, 199 aa, Homo sapiens
MLASLVHVPADGPQDQEEEDQSHCPADDARQGQARHGASVLLLVECGGRAIAVGCLCLGTHRCLISYVGIAGLHGDHADDVGGLGLQGCQQVLCLVPLHQGLRDGAHGWAVAQAQPTEPERGGGERGLPRDADGVCRQGLHVDGQGLGAITRGHGVVNVGVGEAQPWPFGLEGKQGTLGRGGRGVVAGRGLGSRIGHAA

SEQ ID NO: 870921 - protein, 325 aa, Homo sapiens; identical to SEQ ID NO: 870913

SEQ ID NO: 870922 - protein, 313 aa, Homo sapiens
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAANSSLLGGGGVDGCIHRAAGPLLTDECRTLQSCKTGKAKITGGYRLPAKYVIHTVGPIAYGEPSASQAAELRSCYLSSLDLLLEHRLRSVAFPCISTGVFGYPCEAAAEIVLATLREWLEQHKDKDEDIYRSRLPHYFPVA

SEQ ID NO: 870923 - protein, 367 aa, Homo sapiens
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAANSSLLGGGGVDGCIHRAAGPLLTDECRTLQSCKTGKAKITGGYRLPAKYVIHTVGPIAYGEPSASQAAELRSCYLSSLDLLLEHRLRSVAFPCISTGVFGESGRKARTRSGRWTQTPGGAGADRGVGGGQSLGLTPAPPASGYPCEAAAEIVLATLREWLEQHKDKVDRLIICVFLEKDEDIYRSRLPHYFPVA

SEQ ID NO: 870924 - protein, 240 aa, Homo sapiens
DVGRGRGALCACGFGLEGAHRGGGLRGGGSALGGKGVSCPLLPRPAGGSEGAEDRVDPRRSDPVAPRRRHPHSGAHRLRGAQRQSGCRAPQLLPEQSGPAAGAPAPLGGEGRPAGEGGRRGAVTMFQPPLTPPRPGVPLHLHRRVWWVWKKGKDQEWAVDPDAGRGRGGQGSGRGQSLGLTPAPPASGYPCEAAAEIVLATLREWLEQHKDKVDRLIICVFLEKDEDIYRSRLPHYFPVA

SEQ ID NO: 870925 - protein, 188 aa, Homo sapiens
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNADSHSQEDPVPAWNPRE

SEQ ID NO: 870926 - protein, 105 aa, Homo sapiens
KGFAQRDFSEAPKFTQPLADCTTVTGYNTQLFCCVRASPRPKIIWLKNKMDIQGNPKYRALTHLGICSLEIRKPGPFDGGIYTCKAVNPLGEASVDCRVDVKVPN

SEQ ID NO: 870927 - protein, 109 aa, Homo sapiens
SAGRRGGAGGEQGLGARAAPLGAGPPPLRSAPQAGHGWGRRAVTMSALGSPVRAYDFLLKFLLVGDSDVGKGEILASLQDGAAESPYGHPADSSDVAVAKSEGQRCPGD

SEQ ID NO: 870928 - protein, 322 aa, Homo sapiens
SAGRRGGAGGEQGLGARAAPLGAGPPPLRSAPQAGHGWGRRAVTMSALGSPVRAYDFLLKFLLVGDSDVGKGEILASLQDGAAESPYGHPAGIDYKTTTILLDGRRVKLQLWDTSGQGRFCTIFRSYSRGAQGVILVYDIANRWSFDGIDRWIKEIDEHAPGVPKILVGNRLHLAFKRQVPTEQAQAYAERLGVTFFEVSPLCNFNITESFTELARIVLLRHGMDRLWRPSKVLSLQDLCCRAVVSCTPVHLVDKLPLPIALRSHLKSFSMANGLNARMMHGGSYSLTTSSTHKRSSLRKVKLVRPPQSPPKNCTRNSCKIS

SEQ ID NO: 870929 - protein, 239 aa, Homo sapiens
MPSLTLSAGIDYKTTTILLDGRRVKLQLWDTSGQGRFCTIFRSYSRGAQGVILVYDIANRWSFDGIDRWIKEIDEHAPGVPKILVGNRLHLAFKRQVPTEQAQAYAERLGVTFFEVSPLCNFNITESFTELARIVLLRHGMDRLWRPSKVLSLQDLCCRAVVSCTPVHLVDKLPLPIALRSHLKSFSMANGLNARMMHGGSYSLTTSSTHKRSSLRKVKLVRPPQSPPKNCTRNSCKIS

SEQ ID NO: 870930 - protein, 139 aa, Homo sapiens
MSALGSPVRAYDFLLKFLLVGDSDVGKGEILASLQDGAAESPYGHPAGIDYKTTTILLDGRRVKLQLWDTSGQGRFCTIFRSYSRGAQGVILVYDIANRWSFDGIDRWIKEIDESRSRSWPGSCCCGMGWTGSGGRARC

SEQ ID NO: 870931 - protein, 101 aa, Homo sapiens
HADVRSRGSRKVLSLQDLCCRAVVSCTPVHLVDKLPLPIALRSHLKSFSMANGLNARMMHGGSYSLTTSSTHKRSSLRKVKLVRPPQSPPKNCTRNSCKIS

SEQ ID NO: 870932 - protein, 115 aa, Homo sapiens
MSALGSPVRAYDFLLKFLLVGDSDVGKGEILASLQDGAAESPYGHPAGIDYKTTTILLDGRRVKLQLWDTSGQGRFCTIFRSYSRGAQGVILVYDIANRWSFDGIDRWIKEIDEC

SEQ ID NO: 870933 - protein, 216 aa, Homo sapiens
VCKDGLSKRGPMLRFWVDMNSWGVPRPRAPTLRRQQNLTEVTHAPRLSPARYHAPGVPKILVGNRLHLAFKRQVPTEQAQAYAERLGVTFFEVSPLCNFNITESFTELARIVLLRHGMDRLWRPSKVLSLQDLCCRAVVSCTPVHLVDKLPLPIALRSHLKSFSMANGLNARMMHGGSYSLTTSSTHKRSSLRKVKLVRPPQSPPKNCTRNSCKIS

SEQ ID NO: 870934 - protein, 322 aa, Homo sapiens; identical to SEQ ID NO: 870928

SEQ ID NO: 870935 - protein, 322 aa, Homo sapiens; identical to SEQ ID NO: 870928

SEQ ID NO: 870936 - protein, 1594 aa, Homo sapiens
KHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVGQAWLNQVLQRHDIARVLEPLLLLLLHPKTQRVSVQRVQAERYWNKSPCYPGEESDKHFMQNFACSNVSQVQLITSKGNGEKPLTMDEIENFSLTVNPLSDRLSLLSTSSETIPMVVSDFDLPDQQIEILQSSDSGCSQSSAGDNLSYEVDPETVNAQEDSQMPKESSPDDDVQQVVFDLICKVVSGLEVESASVTSQLEIEAMPPKCSDIDPDEETIKIEDDSIQQSQNALLSNESSQFLSVSAEGGHECVANGISRNSSSPCISGTTHTLHDSSVASIETKSRQRSHSSIQFSFKEKLSEKVSEKETIVKESGKQPGAKPKVKLARKKDDDKKKSSNEKLKQTSVFFSDGLDLENWYSCGEGDISEIESDMGSPGSRKSPNFNIHPLYQHVLLYLQLYDSSRTLYAFSAIKAILKTNPIAFVNAISTTSVNNAYTPQLSLLQNLLARHRISVMGKDFYSHIPVDSNHNFRSSMYIEILISLCLYYMRSHYPTHVKVTAQDLIGNRNMQMMSIEILTLLFTELAKVIESSAKGFPSFISDMLSKCKVQKVILHCLLSSIFSAQKWHSEKMAGKNLVAVEEGFSEDSLINFSEDEFDNGSTLQSQLLKVLQRLIVLEHRVMTIPEENETGFDFVVSDLEHISPHQPMTSLQYLHAQPITCQGMFLCAVIRALHQHCACKMHPQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRIPVPNLVDSWASLLILLKDSIQLSLPAPGQFLILGVLNEFIMKNPSLENKKDQRDLQDVTHKIVDAIGAIAGSSLEQTTWLRRNLEVKPSPKIMVDGTNLESDVEDMLSPAMETANITPSVYSVHALTLLSEVLAHLLDMVFYSDEKERVIPLLVNIMHYVVPYLRNHSAHNAPSYRACVQLLSSLSGYQYTRRAWKKEAFDLFMDPSFFQMDASCVNHWRAIMDNLMTHDKTTFRDLMTRVAVAQSSSLNLFANRDVELEQRAMLLKRLAFAIFSSEIDQYQKYLPDIQERLVESLRLPQVPTLHSQVFLFFRVLLLRMSPQHLTSLWPTMITELVQVFLLMEQELTADEDISRTSGPSVAGLETTYTGGNGFSTSYNSQRWLNLYLSACKFLDLALALPSENLPQFQMYRWAFIPEASDDSGLEVRRQGIHQREFKPYVVRLAKLLRKRAKKNPEEDNSGRTLGWEPGHLLLTICTVRSMEQLLPFFNVLSQVFNSKVTSRCGGHSGSPILYSNAFPNKDMKLENHKPCSSKARQKIEEMVEKDFLEGMIKT

SEQ ID NO: 870937 - protein, 812 aa, Homo sapiens
MSIAQQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRIPVPNLVDSWASLLILLKDSIQLSLPAPGQFLILGVLNEFIMKNPSLENKKDQRDLQDVTHKIVDAIGAIAGSSLEQTTWLRRNLEVKPSPKIMVDGTNLESDVEDMLSPAMETANITPSVYSVHALTLLSEVLAHLLDMVFYSDEKERVIPLLVNIMHYVVPYLRNHSAHNAPSYRACVQLLSSLSGYQYTRRAWKKEAFDLFMDPSFFQMDASCVNHWRAIMDNLMTHDKTTFRDLMTRVAVAQSSSLNLFANRDVELEQRAMLLKRLAFAIFSSEIDQYQKYLPDIQERLVESLRLPQVPTLHSQVFLFFRVLLLRMSPQHLTSLWPTMITELVQVFLLMEQELTADEDISRTSGPSVAGLETTYTGGNGFSTSYNSQRWLNLYLSACKFLDLALALPSENLPQFQMYRWAFIPEASDDSGLEVRRQGIHQREFKPYVVRLAKLLRKRAKKNPEEDNSGRTLGWEPGHLLLTICTVRSMEQLLPFFNVLSQVFNSKVTSRCGGHSGSPILYSNAFPNKDMKLENHKPCSSKARQKIEEMVEKDFLEGMIKT

SEQ ID NO: 870938 - protein, 331 aa, Homo sapiens [sequence omitted]

SEQ ID NO: 870939 - protein, 1489 aa, Homo sapiens
KHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVGQAWLNQVLQRHDIARVLEPLLLLLLHPKTQRVSVQRVQAERYWNKSPCYPGEESDKHFMQNFACSNVSQVQLITSKGNGEKPLTMDEIENFSLTVNPLSDRLSLLSTSSETIPMVVSDFDLPDQQIEILQSSDSGCSQSSAGDNLSYEVDPETVNAQEDSQMPKESSPDDDVQQVVFDLICKVVSGLEVESASVTSQLEIEAMPPKCSDIDPDEETIKIEDDSIQQSQNALLSNESSQFLSVSAEGGHECVANGISRNSSSPCISGTTHTLHDSSVASIETKSRQRSHSSIQFSFKEKLSEKVSEKETIVKESGKQPGAKPKVKLARKKDDDKKKSSNEKLKQTSVFFSDGLDLENWYSCGEGDISEIESDMGSPGSRKSPNFNIHPLYQHVLLYLQLYDSSRTLYAFSAIKAILKTNPIAFVNAISTTSVNNAYTPQLSLLQNLLARHRISVMGKDFYSHIPVDSNHNFRSSMYIEILISLCLYYMRSHYPTHVKVTAQDLIGNRNMQMMSIEILTLLFTELAKVIESSAKGFPSFISDMLSKCKVQKVILHCLLSSIFSAQKWHSEKMAGKNLVAVEEGFSEDSLINFSEDEFDNGSTLQSQLLKVLQRLIVLEHRVMTIPEENETGFDFVVSDLEHISPHQPMTSLQYLHAQPITCQGMFLCAVIRALHQHCACKMHPQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRIPVPNLVDSWASLLILLKDSIQLSLPAPGQFLILGVLNEFIMKNPSLENKKDQRDLQDVTHKIVDAIGAIAGSSLEQTTWLRRNLEVKPSPKIMVDGTNLESDVEDMLSPAMETANITPSVYSVHALTLLSEVLAHLLDMVFYSDEKERVIPLLVNIMHYVVPYLRNHSAHNAPSYRACVQLLSSLSGYQYTRRAWKKEAFDLFMDPSFFQMDASCVNHWRAIMDNLMTHDKTTFRDLMTRVAVAQSSSLNLFANRDVELEQRAMLLKRLAFAIFSSEIDQYQKYLPDIQERLVESLRLPQVPTLHSQVFLFFRVLLLRMSPQHLTSLWPTMITELVQVFLLMEQELTADEDISRTSGPSVAGLETTYTGGNGFSTSYNSQRWLNLYLLVPNSARGELVSSFFFFFFALSGFIDVSHSVIINSSVNCTSMINYFLFAEFKCKINTTCVV

SEQ ID NO: 870940 - protein, 1594 aa, Homo sapiens; identical to SEQ ID NO: 870936

SEQ ID NO: 870941 - protein, 1559 aa, Homo sapiens
KHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVGQAWLNQVLQRHDIARVLEPLLLLLLHPKTQRVSVQRVQAERYWNKSPCYPGEESDKHFMQNFACSNVSQVQLITSKGNGEKPLTMDEIENFSLTVNPLSDRLSLLSTSSETIPMVVSDFDLPDQQIEILQSSDSGCSQSSAGDNLSYEVDPETVNAQEDSQMPKESSPDDDVQQVVFDLICKVVSGLEVESASVTSQLEIEAMPPKCSDIDPDEETIKIEDDSIQQSQNALLSNESSQFLSVSAEGGHECVANGISRNSSSPCISGTTHTLHDSSVASIETKSRQRSHSSIQFSFKEKLSEKVSEKETIVKESGKQPGAKPKVKLARKKDDDKKKSSNEKLKQTSVFFSDGLDLENWYSCGEGDISEIESDMGSPGSRKSPNFNIHPLYQHVLLYLQLYDSSRTLYAFSAIKAILKTNPIAFVNAISTTSVNNAYTPQLSLLQNLLARHRISVMGKDFYSHIPVDSNHNFRSSMYIEILISLCLYYMRSHYPTHVKVTAQDLIGNRNMQMMSIEILTLLFTELAKVIESSAKGFPSFISDMLSKCKVQKVILHCLLSSIFSAQKWHSEKMAGKNLVAVEEGFSEDSLINFSEDEFDNGSTLQSQLLKVLQRLIVLEHRVMTIPEENETGFDFVVSDLEHISPHQPMTSLQYLHAQPITCQGMFLCAVIRALHQHCACKMHPQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRVLNEFIMKNPSLENKKDQRDLQDVTHKIVDAIGAIAGSSLEQTTWLRRNLEVKPSPKIMVDGTNLESDVEDMLSPAMETANITPSVYSVHALTLLSEVLAHLLDMVFYSDEKERVIPLLVNIMHYVVPYLRNHSAHNAPSYRACVQLLSSLSGYQYTRRAWKKEAFDLFMDPSFFQMDASCVNHWRAIMDNLMTHDKTTFRDLMTRVAVAQSSSLNLFANRDVELEQRAMLLKRLAFAIFSSEIDQYQKYLPDIQERLVESLRLPQVPTLHSQVFLFFRVLLLRMSPQHLTSLWPTMITELVQVFLLMEQELTADEDISRTSGPSVAGLETTYTGGNGFSTSYNSQRWLNLYLSACKFLDLALALPSENLPQFQMYRWAFIPEASDDSGLEVRRQGIHQREFKPYVVRLAKLLRKRAKKNPEEDNSGRTLGWEPGHLLLTICTVRSMEQLLPFFNVLSQVFNSKVTSRCGGHSGSPILYSNAFPNKDMKLENHKPCSSKARQKIEEMVEKDFLEGMIKT

SEQ ID NO: 870942 - protein, 1594 aa, Homo sapiens; identical to SEQ ID NO: 870936

SEQ ID NO: 870943 - protein, 1224 aa, Homo sapiens
KHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVGQAWLNQVLQRHDIARVLEPLLLLLLHPKTQRVSVQRVQAERYWNKSPCYPGEESDKHFMQNFACSNVSQVQLITSKGNGEKPLTMDEIENFSLTVNPLSDRLSLLSTSSETIPMVVSDFDLPDQQIEILQSSDSGCSQSSAGDNLSYEVDPETVNAQEDSQMPKESSPDDDVQQVVFDLICKVVSGLEVESASVTSQLEIEAMPPKCSDIDPDEETIKIEDDSIQQSQNALLSNESSQFLSVSAEGGHECVANGISRNSSSPCISGTTHTLHDSSVASIETKSRQRSHSSIQFSFKEKLSEKVSEKETIVKESGKQPGAKPKVKLARKKDDDKKKSSNEKLKQTSVFFSDGLDLENWYSCGEGDISEIESDMGSPGSRKSPNFNIHPLYQHVLLYLQLYDSSRTLYAFSAIKAILKTNPIAFVNAISTTSVNNAYTPQLSLLQNLLARHRISVMGKDFYSHIPVDSNHNFRSSMYIEILISLCLYYMRSHYPTHVKVTAQDLIGNRNMQMMSIEILTLLFTELAKVIESSAKGFPSFISDMLSKCKVQKVILHCLLSSIFSAQKWHSEKMAGKNLVAVEEGFSEDSLINFSEDEFDNGSTLQSQLLKVLQRLIVLEHRVMTIPEENETGFDFVVSDLEHISPHQPMTSLQYLHAQPITCQGMFLCAVIRALHQHCACKMHPQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRVLNEFIMKNPSLENKKDQRDLQDVTHKIVDAIGAIAGSSLEQTTWLRRNLEVKPSPKIMVDGTNLESDVEDMLSPAMETANITPSVYSVHALTLLSEVLAHLLDMVFYSDEKERVIPLLVNIMHYVVPYLRNHSAHNAPSYRACVQLLSSLSGYQYTRRAWKKEAFDLFMDPSFFQMDASCVNQ

SEQ ID NO: 870944 - protein, 111 aa, Homo sapiens
MDYLGVKSRGSGADLGGEAAGNPARNAQSLSTRIPPSEVPGVQILFAVNSSSSHVWWLVVSRVLQFCIARSIFVRALSVGIGVSRLGVRLSLGGELILPRGTRRHSKPKTA

SEQ ID NO: 870945 - protein, 1114 aa, Homo sapiens
MLKTEKTKPEVLEAHYGSAEPEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKGMKAGKPVVAAPGAGNLTKFEPRAETQSMKIELKKSAASSTTSLGGGKG

SEQ ID NO: 870946 - protein, 1143 aa, Homo sapiens
LRPSVNGRRMVDVPVTSTGVQTDAVSGEAAEEETPAVFIRKSFQEENHIDEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKGMKAGKPVVAAPGAGNLTKFEPRAETQSMKIELKKSAASSTTSLGGGKG

SEQ ID NO: 870947 - protein, 1078 aa, Homo sapiens
MLKTEKTKPEVLEAHYGSAEPEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKESIIIHQLRMNSR

SEQ ID NO: 870948 - protein, 965 aa, Homo sapiens
MLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKGMKAGKPVVAAPGAGNLTKFEPRAETQSMKIELKKSAASSTTSLGGGKG

SEQ ID NO: 870949 - protein, 453 aa, Homo sapiens
MLKTEKTKPEVLEAHYGSAEPEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIASQI

SEQ ID NO: 870950 - protein, 70 aa, Homo sapiens
IQQGWGRSTGTRAVFAHPMTPRTGSGKQEVPGGCGRKCPKASLSPGCPRGSDFPPLPASWLSPEMLRVTA

SEQ ID NO: 870951 - protein, 168 aa, Homo sapiens
AASARRPLPLPAQALQLGQSGGGSGEEWTPLARMVLESVARIVKVQLPAYLKRLPVPESITGFARLTVSEWLRLLPFLGVLALLGYLAVRPFLPKKKQQKDSLINLKIQKENPKVVNEINIEDLCLTKAAYCRCWRSKTFPACDGSHNKHNELTGDNVGPLILKKKEV

SEQ ID NO: 870952 - protein, 168 aa, Homo sapiens; identical to SEQ ID NO: 870951

SEQ ID NO: 870953 - protein, 160 aa, Homo sapiens
RSCLGNACEAVSGCLMPQGLLSSELSPVSFRGKIPGFCREGAELGTGQSLSSPVLLIALFSEWLRLLPFLGVLALLGYLAVRPFLPKKKQQKDSLINLKIQKENPKVVNEINIEDLCLTKAAYCRCWRSKTFPACDGSHNKHNELTGDNVGPLILKKKEV

SEQ ID NO: 870954 - protein, 80 aa, Homo sapiens
AASARRPLPLPAQALQLGQSGGGSGEEWTPLARMVLESVARIVKVQLPAYLKRLPVPESITGFARLTESCSCHPGWSAMA

SEQ ID NO: 870955 - protein, 183 aa, Homo sapiens
AASARRPLPLPAQALQLGQSGGGSGEEWTPLARMVLESVARIVKVQLPAYLKRLPVPESITGFARLTVSEWLRLLPFLGVLALLGYLAVRPFLPKKKQQKDSLINLKIQKENPKVVNEINIEDLCLTKAAYCRCWRSKTVRCLFTCTLKFCSARIVSPLKSPVLKFFKMREFSVIFGIERPYS

SEQ ID NO: 870956 - protein, 168 aa, Homo sapiens; identical to SEQ ID NO: 870951

SEQ ID NO: 870957 - protein, 168 aa, Homo sapiens; identical to SEQ ID NO: 870951

SEQ ID NO: 870958 - protein, 168 aa, Homo sapiens; identical to SEQ ID NO: 870951

SEQ ID NO: 870959 - protein, 433 aa, Homo sapiens
MLAATVLTLALLGNAHACSKGTSHEAGIVCRITKPALLVLNHETAKVIQTAFQRASYPDITGEKAMMLLGQVKYGLHNIQISHLSIASSQVELVEAKSIDVSIQNVSVVFKGTLKYGYTTAWWLGIDQSIDFEIDSAIDLQINTQLTCDSGRVRTDAPDCYLSFHKLLLHLQGEREPGWIKQLFTNFISFTLKLVLKGQICKEINVISNIMADFVQTRAASILSDGDIGVDISLTGDPVITASYLESHHKAVLETWGFNTNQEIFQEVVGGFPSQAQVTVHCLKMPKISCQNKGVVVNSSVMVKFLFPRPDQQHSVAYTFEEDIVTTVQASYSKKKLFLSLLDFQITPKTVSNLTESSSESVQSFLQSMITAVGIPEVMSRLEVVFTALMNSKGVSLFDIINPEIITRDGFLLLQMDFGFPEHLLVDFLQSLS

SEQ ID NO: 870960 - protein, 493 aa, Homo sapiens [sequence omitted]

SEQ ID NO: 870961 - protein, 246 aa, Homo sapiens
MLAATVLTLALLGNAHACSKGTSHEAGIVCRITKPALLVLNHETAKVIQTAFQRASYPDITGEKAMMLLGQVKYGLHNIQISHLSIASSQVELVEAKSIDVSIQNVSVVFKGTLKYGYTTAWWLGIDQSIDFEIDSAIDLQINTQLTCDSGRVRTDAPDCYLSFHKLLLHLQGEREAWVGSKAAVHKISSSFNLLKAGSLNRDRNPAKGEFNAHFFLNHSWAPEFLGSQDPGVLAQAFPFPRNRHA

SEQ ID NO: 870962 - protein, 1103 aa, Homo sapiens
MTACARRAGGLPDPGLCGPAWWAPSLPRLPRALPRLPLLLLLLLLQPPALSAVFTVGVLGPWACDPIFSRARPDLAARLAAARLNRDPGLAGGPRFEVALLPEPCRTPGSLGAVSSALARVSGLVGPVNPAACRPAELLAEEAGIALVPWGCPWTQAEGTTAPAVTPAADALYALLRAFGWARVALVTAPQDLWVEAGRSLSTALRARGLPVASVTSMEPLDLSGAREALRKVRDGPRVTAVIMVMHSVLLGGEEQRYLLEAAEELGLTDGSLVFLPFDTIHYALSPGPEALAALANSSQLRRAHDAVLTLTRHCPSEGSVLDSLRRAQERRELPSDLNLQQVSPLFGTIYDAVFLLARGVAEARAAAGGRWVSGAAVARHIRDAQVPGFCGDLGGDEEPPFVLLDTDAAGDRLFATYMLDPARGSFLSAGTRMHFPRGGSAPGPDPSCWFDPNNICGGGLEPGLVFLGFLLVVGMGLAGAFLAHYVRHRLLHMQMVSGPNKIILTVDDITFLHPHGGTSRKVAQGSRSSLGARSMSDIRSGPSQHLDSPNIGVYEGDRVWLKKFPGDQHIAIRPATKTAFSKLQELRHENVALYLGLFLARGAEGPAALWEGNLAVVSEHCTRGSLQDLLAQREIKLDWMFKSSLLLDLIKGIRYLHHRGVAHGRLKSRNCIVDGRFVLKITDHGHGRLLEAQKVLPEPPRAEDQLWTAPELLRDPALERRGTLAGDVFSLAIIMQEVVCRSAPYAMLELTPEEVVQRVRSPPPLCRPLVSMDQAPVECILLMKQCWAEQPELRPSMDHTFDLFKNINKGRKTNIIDSMLRMLEQYSSNLEDLIRERTEELELEKQKTDRLLTQMLPPSVAEALKTGTPVEPEYFEQVTLYFSDIVGFTTISAMSEPIEVVDLLNDLYTLFDAIIGSHDVYKVETIGDAYMVASGLPQRNGQRHAAEIANMSLDILSAVGTFRMRHMPEVPVRIRIGLHSGPCVAGVVGLTMPRYCLFGDTVNTASRMESTGLPYRIHVNLSTVGILRALDSGYQVELRGRTELKGKGAEDTFWLVGRRGFNKPIPKPPDLQPGSSNHGISLQEIPPERRRKLEKARPGQFS

SEQ ID NO: 870963 - protein, 463 aa, Homo sapiens
MFKSSLLLDLIKGIRYLHHRGVAHGRLKSRNCIVDGRFVLKITDHGHGRLLEAQKVLPEPPRAEDQLWTAPELLRDPALERRGTLAGDVFSLAIIMQEVVCRSAPYAMLELTPEEVVQRVRSPPPLCRPLVSMDQAPVECILLMKQCWAEQPELRPSMDHTFDLFKNINKGRKTNIIDSMLRMLEQYSSNLEDLIRERTEELELEKQKTDRLLTQMLPPSVAEALKTGTPVEPEYFEQVTLYFSDIVGFTTISAMSEPIEVVDLLNDLYTLFDAIIGSHDVYKVETIGDAYMVASGLPQRNGQRHAAEIANMSLDILSAVGTFRMRHMPEVPVRIRIGLHSGPCVAGVVGLTMPRYCLFGDTVNTASRMESTGLPYRIHVNLSTVGILRALDSGYQVELRGRTELKGKGAEDTFWLVGRRGFNKPIPKPPDLQPGSSNHGISLQEIPPERRRKLEKARPGQFS

SEQ ID NO: 870964 - protein, 343 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 870965 - protein, 464 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKYRREMEASCLLGKAGASLKTFNRVGGEGWGSETLTFTSFPRAVFPAHHPHHGYRCWPGCPCSCSHWSCGRCCAVEEEELRLKRRELLSGCNVKQLPCVGLSGKSLCDFKNPDFSLCRDQPTPVPTMTLFLMLNCIPSPITFPVPEKGLGCLRLCLKFVVH

SEQ ID NO: 870966 - protein, 343 aa, Homo sapiens; identical to SEQ ID NO: 870964

SEQ ID NO: 870967 - protein, 159 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEAKQSSLPTIPIMGIVAGLVVLAAVVTGAAVAAVLWRKKSSD

SEQ ID NO: 870968 - protein, 343 aa, Homo sapiens; identical to SEQ ID NO: 870964

SEQ ID NO: 870969 - protein, 328 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWRAIFPAFLYPNVVFVVLHTSSRCPS

SEQ ID NO: 870970 - protein, 251 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEANPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 870971 - protein, 130 aa, Homo sapiens
PISIQSTLHPVHTPSRSLLHPVHTPSCLHPIQSTPRPVHTLSSTHPIQSTPHPDHTPSSTHPIQYTPLLVYTPSRPHPIQSTLHPVHTPSRPHLTQTTPHPVHTPSSPHPIQTTLYPVHAPYRPYPIQTT

SEQ ID NO: 870972 - protein, 483 aa, Homo sapiens
HGSQLIPRYRVAAGSRAPRLCFPRGSGDMARKALKLASWTSMALAASGIYFYSNKYLDPNDFGAVRVGRAVATTAVISYDYLTSLKSVPYGSEEYLQLRSKIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 870973 - protein, 551 aa, Homo sapiens
HGSQLIPRYRVAAGSRAPRLCFPRGSGDMARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQAPQSSMQEIRQVIREDLGKEIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 870974 - protein, 254 aa, Homo sapiens
RIDVSGEELPPAPLLFQISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 870975 - protein, 310 aa, Homo sapiens
RDCVSRNNNNNKKEMGQKVVRPDVGDSPTRSDVEVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 870976 - protein, 147 aa, Homo sapiens
HGSQLIPRYRVAAGSRAPRLCFPRGSGDMARKALKLASWTSMALAASGIYFYSNKYLDPNDFGAVRVGRAVATTAVISYDYLTSLKSVPYGSEEYLQLRSKSLAVSPRLECIGVISAHCNLYLLGSSDSPASASQVAGTTEIMACHL

SEQ ID NO: 870977 - protein, 590 aa, Homo sapiens
HGSQLIPRYRVAAGSRAPRLCFPRGSGDMARKALKLASWTSMALAASGIYFYSNKYLDPNDFGAVRVGRAVATTAVISYDYLTSLKSVPYGSEEYLQLRSKSLAVSPRLECIGVISAHCNLYLLGSSDSPASASQELGLQVHLRSARRLCELCCANRGTFIKVGQHLGALDYLLPEEYTSTLKVLHSQAPQSSMQEIRQVIREDLGKEIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 870978 - protein, 485 aa, Homo sapiens
HGSQLIPRYRVAAGSRAPRLCFPRGSGDMARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQAPQSSMQEIRQVIREDLGKEIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 870979 - protein, 173 aa, Homo sapiens [sequence omitted]

SEQ ID NO: 870980 - protein, 51 aa, Homo sapiens
PPRIASGARGNAAKALLENFGFELVIQYNENRQKVQKKGKSGEGENTDKLE

SEQ ID NO: 870981 - protein, 256 aa, Homo sapiens
AGSGAAASRPRRIRPAPAGLELDPELGKLEKQAQTRKPRYGKSLSKESFPRFTPRLHQGTAWAYGLPNPKRPQPRAGIRPSGREGRRRPQSAGAGGARPQDARGWVGRREGRQQARGCFPSVRTAGPGGHFESAKRGGKMAAWAPGRSPRQGPAEPLLPFVQPRGPQKRNARRERPVRSPQTDARLFITARPRGKSGCRLPAHSPPDPPSRLPGPRSRSRRARLCVSWLLGRKRLPDMLWSQKTAKREAEAPVARV

SEQ ID NO: 870982 - protein, 74 aa, Homo sapiens
MTCAHCRTPLQKGQTAYQRKGLPQLFCSSSCLTTFSKKPSGKKTCTFCKKEILENKDRLVGGFVLGGFPSHEVP

SEQ ID NO: 870983 - protein, 1358 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 870984 - protein, 827 aa, Homo sapiens
MDPSDFPSPFVTPVYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 870985 - protein, 1370 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 870986 - protein, 1156 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQVPLVHHLTSCHS

SEQ ID NO: 870987 - protein, 1370 aa, Homo sapiens; identical to SEQ ID NO: 870985

SEQ ID NO: 870988 - protein, 82 aa, Homo sapiens
RDALSMLSNMLRSMGITEYQRGDSAMQDRFRLQVEHIVASPEALWYSVIPMDRSMLESMLNRILAVREIYEELGRPGEEDLD

SEQ ID NO: 870989 - protein, 495 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKVGPRE

SEQ ID NO: 870990 - protein, 1104 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKVLKKEHWAPNPILLKKDI

SEQ ID NO: 870991 - protein, 646 aa, Homo sapiens
GGGAGRGRRGGAGAGKGARGRDGRKMAALKEDRSYGLSCGRVSDGSKVSVFHVKLTDSALRAFESYRARQDSVSLRPSIRFQGSQGHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYETTRGQILQEYRKIKKTNTNYSQEKHRCEYLHSKLAHIKRLIAEYDQRQLQAWP

SEQ ID NO: 870992 - protein, 695 aa, Homo sapiens
WSSRLSHLLQDRQEKKFPKPLLVSPRKSSLHHQNQEKPPPVNKQENAGTLNILSTLSNGNSSKQKIPADGVHRIRVDFKNSPCVCQRMLLLCPESTKTAPVSSRAVGKVERTSCKTSHLDSVSLRPSIRFQGSQGHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYETTRGQILQEYRKIKKTNTNYSQEKHRCEYLHSKLAHIKRLIAEYDQRQLQAWP

SEQ ID NO: 870993 - protein, 680 aa, Homo sapiens
VVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKDSVSLRPSIRFQGSQGHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYETTRGQILQEYRKIKKTNTNYSQEKHRCEYLHSKLAHIKRLIAEYDQRQLQAWP

SEQ ID NO: 870994 - protein, 564 aa, Homo sapiens [sequence omitted]

SEQ ID NO: 870995 - protein, 647 aa, Homo sapiens
GGGAGRGRRGGAGAGKGARGRDGRKMAALKEDRSYGLSCGRVSDGSKVSVFHVKLTDSALRAFESYRARQDSVSLRPSIRFQGSQGHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYEVEPPRCLLCPGSGGSQGPLGRAPSPPRAWWPQSLALPQAALLPLVHSMQQPHGS

SEQ ID NO: 870996 - protein, 364 aa, Homo sapiens
GGGAGRGRRGGAGAGKGARGRDGRKMAALKEDRSYGLSCGRVSDGSKVSVFHVKLTDSALRAFESYRARQDSVSLRPSIRFQGSQGHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVGAAPMSCLYQWSPQMVLCGWDGPEHGDWDWDWQGRALPGVSHRFRTCLRARASWIRTSLGGHGCVSGHGPDCPGLRGGLSMEPRPSFTVC

SEQ ID NO: 870997 - protein, 131 aa, Homo sapiens
GGGAGRGRRGGAGAGKGARGRDGRKMAALKEDRSYGLSCGRVSDGSKVSVFHVKLTDSALRAFESYRARQDSVSLRPSIRFQGSQGVSFCLNHSYLESWDWYSLRSVLARWVQQQLMAVFGPCLPPCKAGF

SEQ ID NO: 870998 - protein, 166 aa, Homo sapiens
WSSRLSHLLQDRQEKKFPKPLLVSPRKSSLHHQNQEKPPPVNKQENAGTLNILSTLSNGNSSKQKIPADGVHRIRVDFKDSVSLRPSIRFQGSQGHISIPQPDCPAEARTFSFYLSNIGRDNPQGSFDCIQQYVSSHGEVHLDCLGSIQDKITVCWCRCGVSGCVV

SEQ ID NO: 870999 - protein, 488 aa, Homo sapiens
MAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYETTRGQILQEYRKIKKTNTNYSQEKHRCEYLHSKLAHIKRLIAEYDQRQLQAWP

SEQ ID NO: 871000 - protein, 575 aa, Homo sapiens
HQAHFCTQAHFCTQAHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYETTRGQILQEYRKIKKTNTNYSQEKHRCEYLHSKLAHIKRLIAEYDQRQLQAWP

SEQ ID NO: 871001 - protein, 396 aa, Homo sapiens
GGGAGRGRRGGAGAGKGARGRDGRKMAALKEDRSYGLSCGRVSDGSKVSVFHVKLTDSALRAFESYRARQDSVSLRPSIRFQGSQGHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRASTLSLWGKREVPGFWTSRVSLVN

SEQ ID NO: 871002 - protein, 153 aa, Homo sapiens
TAGLHVQGCAEGLAWLLGGGPAAAEAGARPVMPPPIPQHVPTRMKAARAYPEDAGVVLCGPEGHRAWEQDGRVQVGLSGHPPYCPRGAPGCPVVGEGHAHRVGRRCESLAPTLESSDKRPQSAETLLSCPQLPFMLPSTTWASPQGLGSSLTF

SEQ ID NO: 871003 - protein, 533 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARKAILTTDDRIRKPLMTRVVERSSSMTSTMTIGKFMLALAFFAIIIAYF

SEQ ID NO: 871004 - protein, 486 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARS

SEQ ID NO: 871005 - protein, 396 aa, Homo sapiens
MNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARKAILTTDDRIRKPLMTRVVERSSSMTSTMTIGKFMLALAFFAIIIAYF

SEQ ID NO: 871006 - protein, 480 aa, Homo sapiens
MTSEGSGGSSSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARKAILTTDDRIRKPLMTRVVERSSSMTSTMTIGKFMLALAFFAIIIAYF

SEQ ID NO: 871007 - protein, 533 aa, Homo sapiens; identical to SEQ ID NO: 871003

SEQ ID NO: 871008 - protein, 264 aa, Homo sapiens [sequence omitted]

SEQ ID NO: 871009 - protein, 286 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRYVPRMGVQG

SEQ ID NO: 871010 - protein, 533 aa, Homo sapiens; identical to SEQ ID NO: 871003

SEQ ID NO: 871011 - protein, 515 aa, Homo sapiens
MTKCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARKAILTTDDRIRKPLMTRVVERSSSMTSTMTIGKFMLALAFFAIIIAYF

SEQ ID NO: 871012 - protein, 480 aa, Homo sapiens; identical to SEQ ID NO: 871006

SEQ ID NO: 871013 - protein, 172 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGEQLTRKEDP

SEQ ID NO: 871014 - protein, 943 aa, Homo sapiens [sequence omitted]

SEQ ID NO: 871015 - protein, 282 aa, Homo sapiens
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKSNLGKSYNITALGSGRETSRATGDREDYEHQTIQVYTTRPRGGTPTKKSVVTCTDNNNAGAPSTPSALHHAAPAQGT

SEQ ID NO: 871016 - protein, 925 aa, Homo sapiens
MAASGLDHLKNGYRRRFCRPSRARDINTEQGQNVLEILQDCFEEKSLANDFSTNSTKSVPNSTRKISVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALFQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERKTNLMVNLGIPLGDPLQPTRVKDPETREIILMDLVRPQDTYQFFVKHGELKVYKTLDTPFFSTGKLILGPQEEKGKQHVGQDILVFYVNFGDLLCTLHETPYILSTGDSFYVPSGNYYNIKNLRNEESVLLFTQIKR

SEQ ID NO: 871017 - protein, 785 aa, Homo sapiens
NICDTDVIPSSAQKCKSLSLGTRWNYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALFQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERKTNLMVNLGIPLGDPLQPTRVKDPETREIILMDLVRPQDTYQFFVKHGELKVYKTLDTPFFSTGKLILGPQEEKGKQHVGQDILVFYVNFGDLLCTLHETPYILSTGDSFYVPSGNYYNIKNLRNEESVLLFTQIKR

SEQ ID NO: 871018 - protein, 943 aa, Homo sapiens [sequence omitted]

SEQ ID NO: 871019 - protein, 542 aa, Homo sapiens
MYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERKTNLMVNLGIPLGDPLQPTRVKDPETREIILMDLVRPQDTYQFFVKHGELKVYKTLDTPFFSTGKLILGPQEEKGKQHVGQDILVFYVNFGDLLCTLHETPYILSTGDSFYVPSGNYYNIKNLRNEESVLLFTQIKR

SEQ ID NO: 871020 - protein, 774 aa, Homo sapiens [sequence omitted]

SEQ ID NO: 871021 - protein, 728 aa, Homo sapiens
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALFQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSGKLLFFFCLDFYGIMNME

SEQ ID NO: 871022 - protein, 206 aa, Homo sapiens [sequence omitted]

SEQ ID NO: 871023 - protein, 943 aa, Homo sapiens [sequence omitted]

SEQ ID NO: 871024 - protein, 934 aa, Homo sapiens
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALFQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERIPLGDPLQPTRVKDPETREIILMDLVRPQDTYQFFVKHGELKVYKTLDTPFFSTGKLILGPQEEKGKQHVGQDILVFYVNFGDLLCTLHETPYILSTGDSFYVPSGNYYNIKNLRNEESVLLFTQIKR

SEQ ID NO: 871025 - protein, 943 aa, Homo sapiens [sequence omitted]

SEQ ID NO: 871026 - protein, 420 aa, Homo sapiens
LDKLTNFRLSLNPSGPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERKTNLMVNLGIPLGDPLQPTRVKDPETREIILMDLVRPQDTYQFFVKHGELKVYKTLDTPFFSTGKLILGPQEEKGKQHVGQDILVFYVNFGDLLCTLHETPYILSTGDSFYVPSGNYYNIKNLRNEESVLLFTQIKR

SEQ ID NO: 871027 - protein, 764 aa, Homo sapiens
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALFQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGEQILKLHSVVT

SEQ ID NO: 871028 - protein, 500 aa, Homo sapiens
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALFQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSQKGSTEKIGGFLKERFS

SEQ ID NO: 871029 - protein, 132 aa, Homo sapiens
RGGEGKRGGEGRGGKERGGEGKRGEGRGREGREGQGRAEPGRQPSEEGRRPQPKASRACPGPGLHRPGLWGSQGRHPRSAKPRVPEAQGWRQPGSAYGQARIQTCASLGRLSPGDTKISSLTLVFLGLTSAS

SEQ ID NO: 871030 - protein, 166 aa, Homo sapiens
MLRGVLGKTFRLVGYTIQYGCIAHCAFEYVGGVVMCSGPSMEPTIQNSDIVFAENLSRHFYGIQRGDIVIAKSPSDPKSNICKRVIGLEGDKILTTSPSDFFKSHSYVPMGHVWLEGDNLQNSTDSRCYGPIPYGLIRGRIFFKIWPLSDFGFLRASPNGHRFSDD

SEQ ID NO: 871031 - protein, 136 aa, Homo sapiens
EKCALRKDGRLRRGPGEKGPPVSWLRVSRVLWGPRGDIVIAKSPSDPKSNICKRVIGLEGDKILTTSPSDFFKSHSYVPMGHVWLEGDNLQNSTDSRCYGPIPYGLIRGRIFFKIWPLSDFGFLRASPNGHRFSDD

SEQ ID NO: 871032 - protein, 80 aa, Homo sapiens
MISAFPTEVPLAKAVKFCMIHSRTLEGQCTKRCLNLLNILVSRLNSGTKNRVLHNFFPASRKSLFRLYRVYAGSSQLLGD

SEQ ID NO: 871033 - protein, 81 aa, Homo sapiens
NIRPNAFQIKGNLFREQQRTLYSMSYMNKCWEIYLAYCRPSAAPPHEPTMKMRHFLWMLKDFKMINKELTAATFMEVIAED

SEQ ID NO: 871034 - protein, 519 aa, Homo sapiens
RQPRVRGRAASERFGEQTLPSVAMDCYRTSLSSSWIYPTVILCLFGFFSMMRPSEPFLIPYLSGPDKNLTSAEITNEIFPVWTYSYLVLLLPVFVLTDYVRYKPVIILQGISFIITWLLLLFGQGVKTMQVVEFFYGMVTAAEVAYYAYIYSVVSPEHYQRVSGYCRSVTLAAYTAGSVLAQLLVSLANMSYFYLNVISLASVSVAFLFSLFLPMPKKSMFFHAKPSREIKKSSSVNPVLEETHEGEAPGCEEQKPTSEILSTSGKLNKGQLNSLKPSNVTVDVFVQWFQDLKECYSSKRLFYWSLWWAFATAGFNQVLNYVQILWDYKAPSQDSSIYNGAVEAIATFGGAVAAFAVGYVKVNWDLLGELALVVFSVVNAGSLFLMHYTANIWACYAGYLIFKSSYMLLITIAVFQIAVNLNVERYALVFGINTFIALVIQTIMTVIVVDQRGLNLPVSIQFLVYGSYFAVIAGIFLMRSMYITYSTKSQKDVQSPAPSENPDVSHPEEESNIIMSTKL

SEQ ID NO: 871035 - protein, 122 aa, Homo sapiens
RVRGRAASERFGEQTLPSVGKNISGGELIEEAPSSLGLSSVASLFPGLESWGRVPGSAGLGYTLSRVRSSPPTPQPACWDSPKWVCLEFPFAAFWKRRLNKIMIPVKCQHLLWLHPTFTDFN

SEQ ID NO: 871036 - protein, 75 aa, Homo sapiens
ESSAACAGCVSRGTHGKARKKRKSTPTPHPREEEQPHSPPVGRRAPSRRARRKKSTPTPGPQHPAGFLATSPHPS

SEQ ID NO: 871037 - protein, 98 aa, Homo sapiens
FHFFTMEAATKTQLCLSKTLMPAGRLLPPTPAPSRASLRSGGRVPLQLVCGRATRRPGCLPSTPTGDSTKEAWALCTRQPRFPHSIVFPKETIRLGMV

SEQ ID NO: 871038 - protein, 116 aa, Homo sapiens
YGNTKPLSHYKADCGQGSPGSGQSKPALMAYLPQQLSHISHEQNSLFLMKPKPGNMPFRSLVPPGQEQNPSSVPVQAQATSVGTQPPAVSVASSHNSSPYLSSQQQAAVMAALKAL

SEQ ID NO: 871039 - protein, 111 aa, Homo sapiens
NESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKEQH

SEQ ID NO: 871040 - protein, 111 aa, Homo sapiens [sequence omitted]

SEQ ID NO: 871041 - protein, 144 aa, Homo sapiens
GAQGSLIKLIPPPQCAQQRTPRPADLGKPSFSTTHLPFLEPWRQWRRPRLNCSSSAGTSSACCCRCSGTPCRSWHTRCRGPGGRCWGSAGSEPPTEAPAPSPGRPYHQVLLCISASTGASAAQECGVPCVPSPEEHLARSVRGQ

SEQ ID NO: 871042 - protein, 112 aa, Homo sapiens
MAAVAAASAELLIIGWYIFRVLLQGGSWVSRRRCSGTPCRSWHTRCRGPGGRCWGSAGSEPPTEAPAPSPGRPYHQVLLCISASTGASAAQECGVPCVPSPEEHLARSVRGQ

SEQ ID NO: 871043 - protein, 122 aa, Homo sapiens
WSSRILNEINPPPPVRPTADSETSGSRQTLFLDHPPTILGTMAAVAAASAELLIIGWYIFRVLLQVFLECCIYWVGFAFRNPPGTQPIARSEVFRYSLQKLAYTVSRTGRQVLGERRQRAPN

SEQ ID NO: 871044 - protein, 123 aa, Homo sapiens
GGGRVLKAAATAAAAVRPTADSETSGSRQTLFLDHPPTILGTMAAVAAASAELLIIGWYIFRVLLQVFLECCIYWVGFAFRNPPGTQPIARSEVFRYSLQKLAYTVSRTGRQVLGERRQRAPN

SEQ ID NO: 871045 - protein, 144 aa, Homo sapiens; identical to SEQ ID NO: 871041

SEQ ID NO: 871046 - protein, 230 aa, Homo sapiens
RLQLGRRPRGTKGGRIGGEGAGRGQAKPGGSACCSCPRAPPPPPSPRSRAERSRRANPSQPAGVPEAVAQGGARRSHVAPAAAMADSGTAGGAALAAPAPGPGSGGPGPRVYFQSPPGAAGEGPGGADDEGPVRRQGKVTVKYDRKELRKRLNLEEWILEQLTRLYDCQEEEIPELEIDVDELLDMESDDARAARVKELLVDCYKPTEAFISGLLDKIRGMQKLSTPQKK

SEQ ID NO: 871047 - protein, 88 aa, Homo sapiens
GPQPRAPLTPSLQLRLMSLPPPPPPPQEEEIPELEIDVDELLDMESDDARAARVKELLVDCYKPTEAFISGLLDKIRGMQKLSTPQKK

SEQ ID NO: 871048 - protein, 230 aa, Homo sapiens; identical to SEQ ID NO: 871046

SEQ ID NO: 871049 - protein, 147 aa, Homo sapiens
CRRGTCERRAPPCATASGTAGGGPGPRVYFQSPPGAAGEGPGGADDEGPVRRQGKVTVKYDRKELRKRLNLEEWILEQLTRLYDCQEEEIPELEIDVDELLDMESDDARAARVKELLVDCYKPTEAFISGLLDKIRGMQKLSTPQKK

SEQ ID NO: 871050 - protein, 79 aa, Homo sapiens
TAWVDPRVRQLTRLYDCQEEEIPELEIDVDELLDMESDDARAARVKELLVDCYKPTEAFISGLLDKIRGMQKLSTPQKK

SEQ ID NO: 871051 - protein, 230 aa, Homo sapiens; identical to SEQ ID NO: 871046

SEQ ID NO: 871052 - protein, 147 aa, Homo sapiens; identical to SEQ ID NO: 871049

SEQ ID NO: 871053 - protein, 84 aa, Homo sapiens
DPPPDQPDREWILEQLTRLYDCQEEEIPELEIDVDELLDMESDDARAARVKELLVDCYKPTEAFISGLLDKIRGMQKLSTPQKK

SEQ ID NO: 871054 - protein, 286 aa, Homo sapiens
RLQLGRRPRGTKGGRIGGEGAGRGQAKPGGSACCSCPRAPPPPPSPRSRAERSRRANPSQPAGVPEAVAQGGARRSHVAPAAAMADSGTAGGAALAAPAPGPGSGGPGPRVYFQSPPGAAGEGPGGADDEGPVRRQGKVTVKYDRKELRKRLNLEEWILEQLTRLYDCQEEEIPELEIDVDELLDMESDDARAARVKELLVDCYKPTEVRDFLGGWRGWQGEGSPAPVILGSGLLNVYPPTPSSLHFWPAGQDPGHAEAEHTPEEVRVPDPGERWLPQDNRCPPTS

SEQ ID NO: 871055 - protein, 141 aa, Homo sapiens
GALYTLISGSLTDTQRMTYTNHILLYLPRDQQKGPVGVYDEGPVRRQGKVTVKYDRKELRKRLNLEEWILEQLTRLYDCQEEEIPELEIDVDELLDMESDDARAARVKELLVDCYKPTEAFISGLLDKIRGMQKLSTPQKK

SEQ ID NO: 871056 - protein, 205 aa, Homo sapiens
RLQLGRRPRGTKGGRIGGEGAGRGQAKPGGSACCSCPRAPPPPPSPRSRAERSRRANPSQPAGVPEAVAQGGARRSHVAPAAAMADSGTAGGAALAAPAPGPGSGGPGPRVYFQSPPGAAGEGPGGADDEGPVRRQGKVTVKYDRKELRKRLNLEEWILEQLTRLYDCQEEEIPELEIDVDELLDMESDDARAARVKELLQDPLL

SEQ ID NO: 871057 - protein, 135 aa, Homo sapiens
GRAAGPRARGGPGPRVYFQSPPGAAGEGPGGADDEGPVRRQGKVTVKYDRKELRKRLNLEEWILEQLTRLYDCQEEEIPELEIDVDELLDMESDDARAARVKELLVDCYKPTEAFISGLLDKIRGMQKLSTPQKK

SEQ ID NO: 871058 - protein, 230 aa, Homo sapiens; identical to SEQ ID NO: 871046

SEQ ID NO: 871059 - protein, 216 aa, Homo sapiens
RRWSLLRSGSLVDATPCCHAWLVLFPVSACVLHVDVCALTALHCVPLCCAWPWLDMLCTCWWCAAGCLCCAPVPPVCLWHVVLCPCDHCCLHFKMHPPVWPACDDVCPGAVGLDDEGPVRRQGKVTVKYDRKELRKRLNLEEWILEQLTRLYDCQEEEIPELEIDVDELLDMESDDARAARVKELLVDCYKPTEAFISGLLDKIRGMQKLSTPQKK

SEQ ID NO: 871060 - protein, 230 aa, Homo sapiens; identical to SEQ ID NO: 871046

SEQ ID NO: 871061 - protein, 230 aa, Homo sapiens; identical to SEQ ID NO: 871046

SEQ ID NO: 871062 - protein, 286 aa, Homo sapiens; identical to SEQ ID NO: 871054

SEQ ID NO: 871063 - protein, 204 aa, Homo sapiens
RLQLGRRPRGTKGGRIGGEGAGRGQAKPGGSACCSCPRAPPPPPSPRSRAERSRRANPSQPAGVPEAVAQGGARRSHVAPAAAMADSGTAGGAALAAPAPGPGSGGPGPRVYFQSPPGAAGEGPGGADDEGPVRRQGKVTVKYDRKELRKRLNLEEWILEQLTRLYDCQEEEIPELEIDVDEAFISGLLDKIRGMQKLSTPQKK

SEQ ID NO: 871064 - protein, 2137 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAGYRRELALRNELIRQEKLEQLARRFDRKAAMRETWLNENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRMSHLEQCFEELSNMAAGARTQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERDVHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPVSLWSRLSSSWESLQPEPSHPY

SEQ ID NO: 871065 - protein, 2328 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAGYRRELALRNELIRQEKLEQLARRFDRKAAMRETWLNENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRMSHLEQCFEELSNMAAGARTQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERDVHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNRSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 871066 - protein, 2272 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAGYRRELALRNELIRQEKLEQLARRFDRKAAMRETWLNENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRMSHLEQCFEELSNMAAGARTQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERDVHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNRSWNNLYCVLRNSELTFYKDAKNLALGMPYHGEEPLALRHAICEIAANYKKKKHVFKLRLNNGSEWLFSLQG

SEQ ID NO: 871067 - protein, 2208 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAGYRRELALRNELIRQEKLEQLARRFDRKAAMRETWLNENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRMSHLEQCFEELSNMAAGARTQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQNTLWLTWSPQTPWKLQRLEIRKFEDFWLLRMDTGWNALGRMWEIRSHTLAQCLGFQEFQKDAKQAEAILSNEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERDVHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPVSLWSRLSSSWESLQPEPSHPY

SEQ ID NO: 871068 - protein, 2106 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAGYRRELALRNELIRQEKLEQLARRFDRKAAMRETWLNENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRMSHLEQCFEELSNMAAGARTQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERDVHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTASRGGRRDSRGGSSFPPCGHRENVPGQSLVSFV

SEQ ID NO: 871069 - protein, 2259 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAGYRRELALRNELIRQEKLEQLARRFDRKAAMRETWLNENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRMSHLEQCFEELSNMAAGARTQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERDVHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNRSWNNLYCVLRNSELTFYKDAKNLALGMPYHGEEPLALRHAICEIAANYKKKKHVFKLR

SEQ ID NO: 871070 - protein, 1830 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAGYRRELALRNELIRQEKLEQLARRFDRKAAMRETWLNENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRMSHLEQCFEELSNMAAGARTQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGPINEKVSLACPRILGLYSI

SEQ ID NO: 871071 - protein, 131 aa, Homo sapiens
CSSTETPLGLWTTPSVARSNEPALPARGRSGRRRSLGRELAPGTPSDCGVSLSVLLSGCPPRSLVVSVGAQALKNLLVAGPRAQERCQRAGASPEPREEGCNGSPIVDRDIRIPSPGSLKTSPEFGSWKEL

SEQ ID NO: 871072 - protein, 124 aa, Homo sapiens
MEGEACAGTWVARGPAPVLGGQGLSGPCTRSGRLVPLAPGSEGLSTWASSCRGGTGSPSTAGLPALTTLELSPGLSHLPAGQGSGLAACHAQASLRWAPCEARASRMGASHCSTAPGPVHCPRA

SEQ ID NO: 871073 - protein, 131 aa, Homo sapiens; identical to SEQ ID NO: 871071

SEQ ID NO: 871074 - protein, 131 aa, Homo sapiens; identical to SEQ ID NO: 871071

SEQ ID NO: 871075 - protein, 124 aa, Homo sapiens; identical to SEQ ID NO: 871072

SEQ ID NO: 871076 - protein, 131 aa, Homo sapiens; identical to SEQ ID NO: 871071

SEQ ID NO: 871077 - protein, 124 aa, Homo sapiens; identical to SEQ ID NO: 871072

SEQ ID NO: 871078 - protein, 85 aa, Homo sapiens
CSSTETPLGLWTTPSVARSNEPALPARGRSGRRRSLGRELAPGTPSDCGVSLSVLLSGCPPRSLVVSVGAQALKNLLVAGPRGNC

SEQ ID NO: 871079 - protein, 51 aa, Homo sapiens
WQPELMNKTGEYVGISPPLLCLHSSSESGDSRNFLGVTVPSKLQVALGERK

SEQ ID NO: 871080 - protein, 105 aa, Homo sapiens
RWSLTLWPRLHEYSSTLWGKPPFPSLAFSQEGNVSSPLLASCLVPHTLLPGRRGRSSWKWIEPVFLCEPASPRHLVSRFSCRPEFHRAGPAHGGLWRPTLLVAGQ

SEQ ID NO: 871081 - protein, 307 aa, Homo sapiens
MRASEQQHRPRVAAQLLGHVEVEVLAHGAHHQPLPTVGHDLQRQRHKVVEGGVQHQCTQLRVGHGGPGGREAANRPAVDHQVRGREVQAVQCVLDHHVHGVGVVLREGHASAAAEAGVVPAQHGVAGLERCRQTAHLVEARVAFAADDEARPVHVAARVLAAVHEHSVDLVAVTGHQLGAPAVVALHEALLALLQQRQQRARHQGHGAGVHEPAAQRVGQRVASELAGQLAELLQEALRLAARPTWRPPQRIPAQASRPAATTRPPRLPRRSAPGGCCSGPRRARHPSGRPRASRGMGRCSWRSGRS

SEQ ID NO: 871082 - protein, 307 aa, Homo sapiens; identical to SEQ ID NO: 871081

SEQ ID NO: 871083 - protein, 312 aa, Homo sapiens
MVMVLSESLSTRGADSIACGTFSRELHTPKKMSQGPTLFSCGIMENDRWRDLDRKCPLQIDQPSTSIWECLPEKDSSLWHREAVTACAVTSLIKDLSISDHNGNPSAPPSKRQCRSLSFSDEMSSCRTSWRPLGSKVWTPVEKRRCYSGGSVQRYSNGFSTMQRSSSFSLPSRANVLSSPCDQAGLHHRFGGQPCQGVPGSAPCGQAGDTWSPDLHPVGGGRLDLQRSLSCSHEQFSFVEYCPPSANSTPASTPELARRSSGLSRSRSQPCVLNDKKVGVKRRRPEEVQEQRPSLDLAKMAQAAQCRLLLRE

SEQ ID NO: 871084 - protein, 422 aa, Homo sapiens
MVMVLSESLSTRGADSIACGTFSRELHTPKKMSQGPTLFSCGIMENDRWRDLDRKCPLQIDQPSTSIWECLPEKDSSLWHREAVTACAVTSLIKDLSISDHNGNPSAPPSKRQCRSLSFSDEMSSCRTSWRPLGSKVWTPVEKRRCYSGGSVQRYSNGFSTMQRSSSFSLPSRANVLSSPCDQAGLHHRFGGQPCQGVPGSAPCGQAGDTWSPDLHPVGGGRLDLQRSLSCSHEQFSFVEYCPPSANSTPASTPELARRSSGLSRSRSQPCVLNDKKVGVKRRRPEEVQEQRPSLDLAKMAQNCQTFSSLSCLSAGTEDCGPQSPFARHVSNTRAWTALLSASGPGGRTPAGTPVPEPLPPSFDDHLACQEDLSCEESDSCALDEDCGRRAEPAAAWRDRGAPGNSLCSLDGELDIEQIEKN

SEQ ID NO: 871085 - protein, 422 aa, Homo sapiens; identical to SEQ ID NO: 871084

SEQ ID NO: 871086 - protein, 300 aa, Homo sapiens
MSSCRTSWRPLGSKVWTPVEKRRCYSGGSVQRYSNGFSTMQRSSSFSLPSRANVLSSPCDQAGLHHRFGGQPCQGVPGSAPCGQAGDTWSPDLHPVGGGRLDLQRSLSCSHEQFSFVEYCPPSANSTPASTPELARRSSGLSRSRSQPCVLNDKKVGVKRRRPEEVQEQRPSLDLAKMAQNCQTFSSLSCLSAGTEDCGPQSPFARHVSNTRAWTALLSASGPGGRTPAGTPVPEPLPPSFDDHLACQEDLSCEESDSCALDEDCGRRAEPAAAWRDRGAPGNSLCSLDGELDIEQIEKN

SEQ ID NO: 871087 - protein, 422 aa, Homo sapiens; identical to SEQ ID NO: 871084

SEQ ID NO: 871088 - protein, 422 aa, Homo sapiens; identical to SEQ ID NO: 871084

SEQ ID NO: 871089 - protein, 306 aa, Homo sapiens
PSLWRPQRPSRTWSEMSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKVEDFLNLSTQLSGFHICIDKGTFDAISLNPDNAIEKRKQYVKSLSRVLKVKGFFLITSCNWTKEELLNEFSEGWSTVAGFWLTAALTSWAQAIFSTSASRVGGTTGTHHHAWIIFVFLAETRFCHVVQAGLELLGSSDSPTWPPKVLGLYHARPSLAF

SEQ ID NO: 871090 - protein, 422 aa, Homo sapiens; identical to SEQ ID NO: 871084

SEQ ID NO: 871091 - protein, 251 aa, Homo sapiens
PSLWRPQRPSRTWSEMSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKVEDFLNLSTQLSGFHICIDKGTFDAISLNPDNAIEKRKQYVKSLSRVLKVKGFFLITSCNWTKEELLNEFSEGFELLEELPTPKFSFGGRSGNSVAALVFQKM

SEQ ID NO: 871092 - protein, 306 aa, Homo sapiens; identical to SEQ ID NO: 871089

SEQ ID NO: 871093 - protein, 270 aa, Homo sapiens
PSLWRPQRPSRTWSEMSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKVEDFLNLSTQLSGFHICIDKGTFDAISLNPDNAIEKRKQYVKSLSRVLKVKGFFLITSCNWTKEELLNEFSEGWSTVAGFWLTAALTSWAQAIFSTSASRDLNFSKSYQHPSSALEADLETV

SEQ ID NO: 871094 - protein, 148 aa, Homo sapiens
PSLWRPQRPSRTWSEMSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLK

SEQ ID NO: 871095 - protein, 422 aa, Homo sapiens; identical to SEQ ID NO: 871084

SEQ ID NO: 871096 - protein, 422 aa, Homo sapiens; identical to SEQ ID NO: 871084

SEQ ID NO: 871097 - protein, 116 aa, Homo sapiens
RPPAGEHQNLEPGPSSADQTSQSPAPVEGTGPLPSRDSVSPGEAENSCFPSSLHGSVTHQAQDFSSAPSSLRLPLWLWRVGRAGVVSPCVGQLQPGLPPSQIPSQGKYRGASVMFA

SEQ ID NO: 871098 - protein, 422 aa, Homo sapiens; identical to SEQ ID NO: 871084

SEQ ID NO: 871099 - protein, 422 aa, Homo sapiens; identical to SEQ ID NO: 871084

SEQ ID NO: 871100 - protein, 111 aa, Homo sapiens
PSLWRPQRPSRTWSEMSSGADGGGGAAVAARSDKGSPGEDGFVPSALGTREHWDAVYERELQTFREYGDTGEIWFGEESMNRLIRWMQKHKIPLDASVLDIGTGNGKIWFL

SEQ ID NO: 871101 - protein, 306 aa, Homo sapiens; identical to SEQ ID NO: 871089

SEQ ID NO: 871102 - protein, 161 aa, Homo sapiens
PSLWRPQRPSRTWSEMSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKGVESKRLFSNNVM

SEQ ID NO: 871103 - protein, 305 aa, Homo sapiens
MVMVLSESLSTRGADSIACGTFSRELHTPKKMSQGPTLFSCGIMENDRWRDLDRKCPLQIDQPSTSIWECLPEKDSSLWHREAVTACAVTSLIKDLSISDHNGNPSAPPSKRQCRSLSFSDEMSSCRTSWRPLGSKVWTPVEKRRCYSGGSVQRYSNGFSTMQRSSSFSLPSRANVLSSPCDQAGLHHRFGGQPCQGVPGSAPCGQAGDTWSPDLHPVGGGRLDLQRSLSCSHEQFSFVEYCPPSANSTPASTPELARRSSGLSRSRSQPCVLNDKKVGVKRRRPEEVQEQRPSLDLAKMAQIAP

SEQ ID NO: 871104 - protein, 71 aa, Homo sapiens
AYPGVAEASCEAGESLEPEEAEVAVSQERDRKFREEELRHQEQGRKFLEEEQRLRRQERERKFLKEEQQLR

SEQ ID NO: 871105 - protein, 200 aa, Homo sapiens
EEEELQRQKRKQRYRDEDQRSDLKWQWEPEKENAVRDNKVYCKGRENEQFRQLEDSQLRDRQSQQDLQHLLGEQQERDREQERRRWQQRDRHFPEEEQLEREEQKEAKRRDRKSQEEKQLLREEREEKRRRQETDRKFREEEQLLQEREEQPLRRQERDRKFREEELRHQEQGRKFLEEEQRLRRQERERKFLKEEQQLR

SEQ ID NO: 871106 - protein, 114 aa, Homo sapiens
MHSEHVTLAGNKTVTRLSRVSALPVKQAQPLHIPSYSLFIHDKKTVLTNNHSTATGKGEKKRNLCGLNRHQDCSLTSPLATQTHTFHTKPPCATVRRQWEAGLLVSANKNPSIL

SEQ ID NO: 871107 - protein, 237 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGGFFPWLKVYYYRFVIGLRVWQWEVISCKLIKRATTRQP

SEQ ID NO: 871108 - protein, 519 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 871109 - protein, 237 aa, Homo sapiens; identical to SEQ ID NO: 871107

SEQ ID NO: 871110 - protein, 477 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPDFQANFICSYLVSVHQE

SEQ ID NO: 871111 - protein, 423 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVKRESDQGTPFPACAGNHEPGRLYSDFLLLA

SEQ ID NO: 871112 - protein, 519 aa, Homo sapiens; identical to SEQ ID NO: 871108

SEQ ID NO: 871113 - protein, 482 aa, Homo sapiens
YCKPINKYRITLSKEGCLKAGEAVNLNMRQFDLSPITLRSLWLILYQFLYYVASDEKLFPHNALGLFLSIDVRLINVAEYSQLLMNADQLSLIIGKQTICTKHDNSELSGYILLCNHQIMRNKNETIFTTMFRLIMMDPTSEKSMALEISRQISSAHIWFLCIRSETEVQGVACLSRPLSTGMNECKEWVLRDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 871114 - protein, 456 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADALVALVGLFVLLAFLQYRRLRKGYTPLMETHLSSKRYTEEA

SEQ ID NO: 871115 - protein, 88 aa, Homo sapiens
KQWYQRRVAITAGGYILLCNHQIMRNKNETIFTTMFRLIMMDPTSEKLMALEISRQISSAHIWFLCIRSETEVLGRGLSVEAPLYWNE

SEQ ID NO: 871116 - protein, 1829 aa, Homo sapiens
TVVPIVLPTGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTYLNKHRRYEIRMSVYNAVGEGPSSPPQEVFVGEAVPTAAPRNVVVHGATATQLDVTWEPPPLDSQNGDIQGYKIYFWEAQRGNLTERVKTLFPAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQRGISRAQAYSYTESDSGEPDHTTVTNSTSTQQGSLFRPKASRTPTPQNPPNPPSQQSTLYRPPSSLAPGSRAPIAGFSSFV

SEQ ID NO: 871117 - protein, 1992 aa, Homo sapiens
TVVPIVLPTGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFPAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQRGISRAQAYSYTESDSGEPDHTTVTNSTSTQQGSLFRPKASRTPTPQNPPNPPSQQSTLYRPPSKAGVQKEGENRERMCVAQQLFSFEMVGFTAPLGITRSWGSGCVTAMDTEWGGHLERERERRLRTGGRQAGVAEGRKSFWMSSQLPPSSPSRTPGPTAAALCKKNGHPGGHAYLLSLLLLPSMHHHCGWQASDSLIQTPCPVLATSTAHLPCSTSPPSIWFI

SEQ ID NO: 871118 - protein, 1597 aa, Homo sapiens
TVVPIVLPTGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFPAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSGAPRPAGLRPHSSLSPFFLGPSTWGTCLCPPPEKALVLLQVKSPGPVEEWETGLGGS

SEQ ID NO: 871119 - protein, 1481 aa, Homo sapiens
SRRLGGKRVHIARRDRGNSLQLSTGDFTAVDPQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTYLNKHRRYEIRMSVYNAVGEGPSSPPQEVFVGEAVPTAAPRNVVVHGATATQLDVTWEPPPLDSQNGDIQGYKIYFWEAQRGNLTERVKTLFPAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQRGISRAQAYSYTESDSGEPDHTTVTNSTSTQQGSLFRPKASRTPTPQNPPNPPSQQSTLYRPPSSLAPGSRAPIAGFSSFV

SEQ ID NO: 871120 - protein, 30 aa, Homo sapiens
CRNSQHQRYLLQGLLGGFLEERNANEYDCK

SEQ ID NO: 871121 - protein, 1060 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASLLNDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERAATGVHIEPPWGAASAMAEQSEWLSVQAAR

SEQ ID NO: 871122 - protein, 102 aa, Homo sapiens
RGSRIASVFHQIWQGFYLISPSEFERFSLSTKWLVEPRCLVDSAETKNHRPGNGAGPKKAPSRARNSGTQSDGEEKQPGLVMERALLSDEKILKEIQSTGTE

SEQ ID NO: 871123 - protein, 1021 aa, Homo sapiens
MRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASLLNDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERVLKEIQSTLEGDRGSGNWRSHRAAVGCSLSNGGAE

SEQ ID NO: 871124 - protein, 1044 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASLLNDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERVLKEIQSTLEGDRG

SEQ ID NO: 871125 - protein, 1040 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASLLNDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEALGPGLPHPDLSKERESQAEEGPGGAP

SEQ ID NO: 871126 - protein, 1065 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASLLNDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERVLKEIQSTLEGDRGSGNWRSHRAAVGCSLSNGGAE

SEQ ID NO: 871127 - protein, 1084 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASLLNDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGLTVMAREAAGLEMSAPGQDERVRRKSQALGGTRERTGGPSSPRGAPTRGQTRPTHTGEDQSEAPGRAPTEAGPQQER

SEQ ID NO: 871128 - protein, 958 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASLLNDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQEAFLP

SEQ ID NO: 871129 - protein, 400 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASRRASGVGAQG

SEQ ID NO: 871130 - protein, 365 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYVGELREWVPRVRCGRHGAGPSVKTGPGAVAPACNPSAVGGQGGRIA

SEQ ID NO: 871131 - protein, 758 aa, Homo sapiens
MEEKPGKRVGRHSCMPLGCLSWLGPCLPARCIPPGALCQGALSSLCMQSQGYCPHLLPSWRWKGFAQAAKNRAFWICRCPGSNPGASDSTELGCFLLAPAPDPCPVPQAFDDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEALGPGLPHPDLSKERESQAEEGPGGAP

SEQ ID NO: 871132 - protein, 1065 aa, Homo sapiens; identical to SEQ ID NO: 871126

SEQ ID NO: 871133 - protein, 1040 aa, Homo sapiens; identical to SEQ ID NO: 871125

SEQ ID NO: 871134 - protein, 932 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASLLNDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQAST

SEQ ID NO: 871135 - protein, 412 aa, Homo sapiens
TTRNLDQHTSSGGRSLLCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERVLKEIQSTLEGDRGSGNWRSHRAAVGCSLSNGGAE

SEQ ID NO: 871136 - protein, 340 aa, Homo sapiens [sequence omitted]

SEQ ID NO: 871137 - protein, 297 aa, Homo sapiens
AAQQPVGRRGGASGAGGGRRGTPRPRAGAGPGFQVSSGGCRLSKMRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGS

SEQ ID NO: 871138 - protein, 128 aa, Homo sapiens
QLENIWWQRDGRLLVSCHSDGSYCQWPVSSEAQQPEPLRSLVPYAVFHPPGRAHPQCLLDSGAGCSILKQTPGPERVKALSKATQQGSPHPVSWGTSRSKIPKHRSTMWMWHELEGSVPVGTDTCLRV

SEQ ID NO: 871139 - protein, 77 aa, Homo sapiens
RNPLQETSAYLSVIKNLFTTVTYHVLPIRILASVLHSIYSTAFFTVFLMPKLGLLHQSAHVHALNSHSHLFHSPLNC

SEQ ID NO: 871140 - protein, 587 aa, Homo sapiens
MPTALCPRVLAPKESEEPRKMRSPPGENPSPQGELPSPESSRRLFRRFRYQEAAGPREALQRLWDLCGGWLRPERHTKEQILELLVLEQFLAILPREIQSWVRAQEPESGEQAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 871141 - protein, 567 aa, Homo sapiens
MRSPPGENPSPQGELPSPESSRRLFRRFRYQEAAGPREALQRLWDLCGGWLRPERHTKEQILELLVLEQFLAILPREIQSWVRAQEPESGEQAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 871142 - protein, 587 aa, Homo sapiens; identical to SEQ ID NO: 871140

SEQ ID NO: 871143 - protein, 567 aa, Homo sapiens; identical to SEQ ID NO: 871141

SEQ ID NO: 871144 - protein, 159 aa, Homo sapiens
EDPPCWPTCSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 871145 - protein, 567 aa, Homo sapiens; identical to SEQ ID NO: 871141

SEQ ID NO: 871146 - protein, 123 aa, Homo sapiens
ARARPPRRRLPAQSPALRKVRAGEKATPLFFRRLHLPPSRAVAFRMIGRRGLDGPGKEPGACGDPASASTPGRAGWEDEDGCPGLPPPQEGFRPDAGRELQAVSSICKGLNNKNSDFGSGASR

SEQ ID NO: 871147 - protein, 587 aa, Homo sapiens; identical to SEQ ID NO: 871140

SEQ ID NO: 871148 - protein, 623 aa, Homo sapiens
MPTALCPRVLAPKESEEPRKMRSPPGENPSPQGELPSPESSRRLFRRFRYQEAAGPREALQRLWDLCGGWLRPERHTKEQILELLVLEQFLAILPREIQSWVRAQEPESGEQAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPRIFQFNNHRSNGYILEMLGSGGKKAQIISVLSQIYVSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 871149 - protein, 567 aa, Homo sapiens; identical to SEQ ID NO: 871141

SEQ ID NO: 871150 - protein, 567 aa, Homo sapiens; identical to SEQ ID NO: 871141

SEQ ID NO: 871151 - protein, 567 aa, Homo sapiens; identical to SEQ ID NO: 871141

SEQ ID NO: 871152 - protein, 325 aa, Homo sapiens
MRSPPGENPSPQGELPSPESSRRLFRRFRYQEAAGPREALQRLWDLCGGWLRPERHTKEQILELLVLEQFLAILPREIQSWVRAQEPESGEQAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPVPAGSVSAGI

SEQ ID NO: 871153 - protein, 92 aa, Homo sapiens
RGGPRPRPEQIRFLAVREILFIHPVSFSNYLKKYHNTICGRHPIGVLLNAITELQKNGMNMSFSFLNYAQSSQCRNWQDSSVSYAAGALTVH

SEQ ID NO: 871154 - protein, 351 aa, Homo sapiens
GGAGRGRRRAAGLEGPAGGGAGPAVSRPLAEPLLPPPPPPPHSSSCTIGGTGTKMSNRVVCREASHAGSWYTASGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 871155 - protein, 297 aa, Homo sapiens
MSNRVVCREASHAGSWYTASGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 871156 - protein, 297 aa, Homo sapiens; identical to SEQ ID NO: 871155

SEQ ID NO: 871157 - protein, 328 aa, Homo sapiens
VHVEIPRRVGSGAGHAQWAGPVRVASGTGTKMSNRVVCREASHAGSWYTASGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 871158 - protein, 297 aa, Homo sapiens; identical to SEQ ID NO: 871155

SEQ ID NO: 871159 - protein, 180 aa, Homo sapiens
MFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 871160 - protein, 301 aa, Homo sapiens
MQILPKKPLHCRGTGDLYDLFISQLTGHKDEFTIIPVLVGALSESKEQEFGKLFSKYLADPSNLFVVSSDFCHSGRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 871161 - protein, 201 aa, Homo sapiens
MQDIRTVGLVLPMLINKWIRLLPGEFSSLGLLIMCPSLDVHFPVWIYIGHLCMTFVLTKRFTENCGRQECLNACLCRQMKMNTVLKCICLIQLKPWKGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 871162 - protein, 147 aa, Homo sapiens
MSNRVVCREASHAGSWYTASGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMERV

SEQ ID NO: 871163 - protein, 123 aa, Homo sapiens
MSNRVVCREASHAGSWYTASGPQLNAQLEGWLSQVQSTKRPARAIIAPRDGSFTSLGNNAMQDIRTVGLVLPMLINKWIRLLRKKCSFVLSRRSLRIYCFVIEVICFLYLLLLCTQFHEGFDF

SEQ ID NO: 871164 - protein, 112 aa, Homo sapiens
MQDIRTVGLVLPMLINKWIRLLPGEFSSLGLLIMCPSLDVHFPVWIYIGHLCMTFVLTKRFTENCGRQECLNACLCRQMKMNTVLKCICLIQLKPWKAIRMSLPLFLYWLEL

SEQ ID NO: 871165 - protein, 297 aa, Homo sapiens; identical to SEQ ID NO: 871155

SEQ ID NO: 871166 - protein, 297 aa, Homo sapiens; identical to SEQ ID NO: 871155

SEQ ID NO: 871167 - protein, 206 aa, Homo sapiens
MSNRVVCREASHAGSWYTASGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGYEYYRTIRPCIF

SEQ ID NO: 871168 - protein, 147 aa, Homo sapiens; identical to SEQ ID NO: 871162

SEQ ID NO: 871169 - protein, 115 aa, Homo sapiens
LFFCSICVMEFVIRSVRWFGSVMCGRWCYCPRAQSVCVWLPSSALVPSLFHWPRSVSRGSCSCRVLFLAVLFLWLFVFLFFFFFFFCFRLFLFFVFFFLFCVFLFFFFFVFFLPS

SEQ ID NO: 871170 - protein, 214 aa, Homo sapiens
MSRKKTPKSKGASTPAASTLPTANGARPARSGTALSGPDAPPNGPLQPGRPSLGGGVDFYDVAFKVMLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKVSQGRGVVRGCPWRLRA

SEQ ID NO: 871171 - protein, 214 aa, Homo sapiens; identical to SEQ ID NO: 871170

SEQ ID NO: 871172 - protein, 214 aa, Homo sapiens
MSRKKTPKSKGASTPAASTLPTANGARPARSGTALSGPDAPPNGPLQPGRPSLGGGVDFYDVAFKVMLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKVHKAFGFSGAVIIFDIF

SEQ ID NO: 871173 - protein, 256 aa, Homo sapiens
MSRKKTPKSKGASTPAASTLPTANGARPARSGTALSGPDAPPNGPLQPGRPSLGGGVDFYDVAFKVMLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKEYGLPFMETSAKTGLNVDLAFTAIAKELKQRSMKAPSEPRFRLHDYVKREGRGASCCRP

SEQ ID NO: 871174 - protein, 214 aa, Homo sapiens; identical to SEQ ID NO: 871170

SEQ ID NO: 871175 - protein, 188 aa, Homo sapiens
MSRKKTPKSKGASTPAASTLPTANGARPARSGTALSGPDAPPNGPLQPGRPSLGGGVDFYDVAFKVMLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSGHELMGE

SEQ ID NO: 871176 - protein, 371 aa, Homo sapiens
GLVEKEGRGAGVGAVPQPRSSSHPGQFSRRAVTGGICPGTRSTVLCVSKMEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRQMALSYFTATTTAVATAVGMNMLTKKAPPLVGRWVPFAAVAAANCVNIPMMRQQELIKGICVKDRNENEIGHSRRAAAIGITQVVISRITMSAPGMILLPVIMERLEKLHFMQKVKVLHAPLQVMLSGCFLIFMVPVACGLFPQKCELPVSYLEPKLQDTIKAKYGELEPYVYFNKGL

SEQ ID NO: 871177 - protein, 371 aa, Homo sapiens
WSFTLRDQAGVQRCDLGSSQPPPLGFKRFSCLSLPSSWDYRSTVLCVSKMEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRQMALSYFTATTTAVATAVGMNMLTKKAPPLVGRWVPFAAVAAANCVNIPMMRQQELIKGICVKDRNENEIGHSRRAAAIGITQVVISRITMSAPGMILLPVIMERLEKLHFMQKVKVLHAPLQVMLSGCFLIFMVPVACGLFPQKCELPVSYLEPKLQDTIKAKYGELEPYVYFNKGL

SEQ ID NO: 871178 - protein, 132 aa, Homo sapiens
PTCSSVLPSGKYFLELLLKEREPLGSWSDFRRSPGESLPALPSASPWSLPVLLPVIMERLEKLHFMQKVKVLHAPLQVMLSGCFLIFMVPVACGLFPQKCELPVSYLEPKLQDTIKAKYGELEPYVYFNKGL

SEQ ID NO: 871179 - protein, 371 aa, Homo sapiens; identical to SEQ ID NO: 871176

SEQ ID NO: 871180 - protein, 128 aa, Homo sapiens
MRQQELIKGICVKDRNENEIGHSRRAAAIGITQVVISRITMSAPGMILLPVIMERLEKLHFMQKVKVLHAPLQVMLSGCFLIFMVPVACGLFPQKCELPVSYLEPKLQDTIKAKYGELEPYVYFNKGL

SEQ ID NO: 871181 - protein, 202 aa, Homo sapiens
WSFTLRDQAGVQRCDLGSSQPPPLGFKRFSCLSLPSSWDYRSTVLCVSKMEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVSLAASHHGKA

SEQ ID NO: 871182 - protein, 385 aa, Homo sapiens
GLVEKEGRGAGVGAVPQPRSSSHPGQFSRRAVTGGICPGTRSTVLCVSKMEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRQMALSYFTATTTAVATAVGMNMLTKKAPPLVGRWVPFAAVAAANCVFIDQKFTAGAHKGSCSEGQELQHEDGAFPGELRGIGHPPQVVISSDSPKSAPWDDLGWQVIIGKAEKLAFMQKSRGPGTPIGGHGEGGLLILMVPGGVAFPQNGNCHSIGTSPKHIGSWNVLCRRSGPRGVQYTSGEVLRRERGGA

SEQ ID NO: 871183 - protein, 126 aa, Homo sapiens
IWDREGKLGILATERHLKIGGRKGVGGFGDVLEYVNEGSGGVLEALGKAKPVFLSFNLFQENYGQKEAEKVARVKALYEELDLPAVFLQYEEDSYSHIMALIEQYAAPLPPAVFLGLARKIYKRRK

SEQ ID NO: 871184 - protein, 88 aa, Homo sapiens
IWLRYDSGSTHNMYREYRDLTTAALSPSATETWVPGTRPSPLHSLPAVFLQYEEDSYSHIMALIEQYAAPLPPAVFLGLARKIYKRRK

SEQ ID NO: 871185 - protein, 167 aa, Homo sapiens
MNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLKPDRALPAEFLSD

SEQ ID NO: 871186 - protein, 167 aa, Homo sapiens; identical to SEQ ID NO: 871185

SEQ ID NO: 871187 - protein, 167 aa, Homo sapiens; identical to SEQ ID NO: 871185

SEQ ID NO: 871188 - protein, 167 aa, Homo sapiens; identical to SEQ ID NO: 871185

SEQ ID NO: 871189 - protein, 167 aa, Homo sapiens; identical to SEQ ID NO: 871185

SEQ ID NO: 871190 - protein, 167 aa, Homo sapiens; identical to SEQ ID NO: 871185

SEQ ID NO: 871191 - protein, 167 aa, Homo sapiens; identical to SEQ ID NO: 871185

SEQ ID NO: 871192 - protein, 251 aa, Homo sapiens
MLSPQRALLCNLNHIHLQHVSLGLHLSRRPELQEGPLSTPPPPGDTGGKESRGPCSGTLVDANSNSPAVPCRCCQEHGPGLENRQDPSQEEEGAASPSDPGCSSSLSSCSDLSPDESPVSVYLRDLPGDEDAHPQPSIIPLEQGSPLASAGPGTCSPDSFCCSPDSCSGASSSPDPGLDSNCNALTTCQDVPSPGLEEEDERAEQDLPTSELLEADDGKIDAGKTEPSWKINPIWKIDTEKTKAEWKTTEN

SEQ ID NO: 871193 - protein, 167 aa, Homo sapiens; identical to SEQ ID NO: 871185

SEQ ID NO: 871194 - protein, 167 aa, Homo sapiens; identical to SEQ ID NO: 871185

SEQ ID NO: 871195 - protein, 167 aa, Homo sapiens; identical to SEQ ID NO: 871185

SEQ ID NO: 871196 - protein, 167 aa, Homo sapiens; identical to SEQ ID NO: 871185

SEQ ID NO: 871197 - protein, 167 aa, Homo sapiens; identical to SEQ ID NO: 871185

SEQ ID NO: 871198 - protein, 167 aa, Homo sapiens; identical to SEQ ID NO: 871185

SEQ ID NO: 871199 - protein, 167 aa, Homo sapiens; identical to SEQ ID NO: 871185

SEQ ID NO: 871200 - protein, 167 aa, Homo sapiens; identical to SEQ ID NO: 871185

SEQ ID NO: 871201 - protein, 167 aa, Homo sapiens; identical to SEQ ID NO: 871185

SEQ ID NO: 871202 - protein, 167 aa, Homo sapiens; identical to SEQ ID NO: 871185

SEQ ID NO: 871203 - protein, 196 aa, Homo sapiens
MNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLKPDRALPAGVLQTGPDAQRVPMVALASIGHAHLAGFREFLSD

SEQ ID NO: 871204 - protein, 229 aa, Homo sapiens
MNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLKPDRALPAGVLQTGPDAQRVPMVALASIGHAHLAGFRVQDCSVPGRERKRGRVLGSGVVVVARKGFSVLCNWKKG

SEQ ID NO: 871205 - protein, 167 aa, Homo sapiens; identical to SEQ ID NO: 871185

SEQ ID NO: 871206 - protein, 203 aa, Homo sapiens
MLAKMASCTSVIILTIRLGSDATSEPGNRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLKPDRALPAEFLSD

SEQ ID NO: 871207 - protein, 251 aa, Homo sapiens; identical to SEQ ID NO: 871192

SEQ ID NO: 871208 - protein, 167 aa, Homo sapiens; identical to SEQ ID NO: 871185

SEQ ID NO: 871209 - protein, 167 aa, Homo sapiens; identical to SEQ ID NO: 871185

SEQ ID NO: 871210 - protein, 167 aa, Homo sapiens; identical to SEQ ID NO: 871185

SEQ ID NO: 871211 - protein, 167 aa, Homo sapiens; identical to SEQ ID NO: 871185

SEQ ID NO: 871212 - protein, 167 aa, Homo sapiens; identical to SEQ ID NO: 871185

SEQ ID NO: 871213 - protein, 167 aa, Homo sapiens; identical to SEQ ID NO: 871185

SEQ ID NO: 871214 - protein, 167 aa, Homo sapiens; identical to SEQ ID NO: 871185

SEQ ID NO: 871215 - protein, 167 aa, Homo sapiens; identical to SEQ ID NO: 871185

SEQ ID NO: 871216 - protein, 167 aa, Homo sapiens; identical to SEQ ID NO: 871185

SEQ ID NO: 871217 - protein, 167 aa, Homo sapiens; identical to SEQ ID NO: 871185

SEQ ID NO: 871218 - protein, 167 aa, Homo sapiens; identical to SEQ ID NO: 871185

SEQ ID NO: 871219 - protein, 167 aa, Homo sapiens; identical to SEQ ID NO: 871185

SEQ ID NO: 871220 - protein, 167 aa, Homo sapiens; identical to SEQ ID NO: 871185

SEQ ID NO: 871221 - protein, 167 aa, Homo sapiens; identical to SEQ ID NO: 871185

SEQ ID NO: 871222 - protein, 229 aa, Homo sapiens; identical to SEQ ID NO: 871204

SEQ ID NO: 871223 - protein, 219 aa, Homo sapiens
MNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLKPDRALPAGTNLLSSTRTAFYSFLPSYKLQPCTWAGIDGEKEHANAKKILLEMGGVFRLVLSDSG

SEQ ID NO: 871224 - protein, 108 aa, Homo sapiens
MASASCSPGRPLASPEPGWQPVINYIDIKFEDYLNAESRVNRCQMPGNRVQCCLYFIAPSGHGDRSHYVAQVILDLLASSDPPTLVSQSAGITDVNYQPSQRAEGFQF

SEQ ID NO: 871225 - protein, 33 aa, Homo sapiens
MTSAHFCPLLEQRRQSWDRTSSPRTNIQCDCGY

SEQ ID NO: 871226 - protein, 114 aa, Homo sapiens
MPHKVFLNCNINLYFQLFTLLSTTFIKTCLHRLLVSIWNGKVSFNTFFFTLCSRAEGVQNHAQFNSPEELCNLYLASTWKKKTIYKNTKLLKCSSTISRLSDSYLQKDRMFVYW

SEQ ID NO: 871227 - protein, 110 aa, Homo sapiens [sequence omitted]

SEQ ID NO: 871228 - protein, 328 aa, Homo sapiens
ARVPLGTARAAASLWGRYLRARTPRSPPRSPSRAPRAPQRWGLLLRGGNVWPAPAARRGPGPRAHDGPARWAMIRLGGWCARRLCSAAVPAGRRGAAGGLGLAGGRALRVLVDMDGVLADFEGGFLRKFRARFPDQPFIALEDRRGFWVSEQYGRLRPGLSVSVPAPPRAGPPSRPEPQTPPLRRGPWTEKAISIWESKNFFFELEPLPGAVEAVKEMASLQNTDVFICTSPIKMFKYCPYEKYAWVEKYFGPDFLEQIVLTRDKTVVSADLLIDDRPDITGAEPTPSWEHVLFTACHNQHLQLQPPRRRLHSWADDWKAILDSKRPC

SEQ ID NO: 871229 - protein, 344 aa, Homo sapiens
ARVPLGTARAAASLWGRYLRARTPRSPPRSPSRAPRAPQRWGLLLRGGNVWPAPAARRGPGPRAHDGPARWAMIRLGGWCARRLCSAAVPAGRRGAAGGLGLAGGRALRVLVDMDGVLADFEGGFLRKFRARFPDQPFIALEDRRGFWVSEQYGRLRPGLSSWPCSTPELNPYHPTPEVFCPGWIEGKDPRRDVYTQILEKAISIWESKNFFFELEPLPGAVEAVKEMASLQNTDVFICTSPIKMFKYCPYEKYAWVEKYFGPDFLEQIVLTRDKTVVSADLLIDDRPDITGKWPATGAEPTPSWEHVLFTACHNQHLQLQPPRRRLHSWADDWKAILDSKRPC

SEQ ID NO: 871230 - protein, 334 aa, Homo sapiens
ARVPLGTARAAASLWGRYLRARTPRSPPRSPSRAPRAPQRWGLLLRGGNVWPAPAARRGPGPRAHDGPARWAMIRLGGWCARRLCSAAVPAGRRGAAGGLGLAGGRALRVLVDMDGVLADFEGGFLRKFRARFPDQPFIALEDRRGFWVSEQYGRLRPGLSVSVPAPPRAGPPSRPEPQTPPLRRGPWTEKAISIWESKNFFFELEPLPGAVEAVKEMASLQNTDVFICTSPIKMFKYCPYEKYAWVEKYFGPDFLEQIVLTRDKTVVSADLLIDDRPDITGKWPATGAEPTPSWEHVLFTACHNQHLQLQPPRRRLHSWADDWKAILDSKRPC

SEQ ID NO: 871231 - protein, 300 aa, Homo sapiens
ARVPLGTARAAASLWGRYLRARTPRSPPRSPSRAPRAPQRWGLLLRGGNVWPAPAARRGPGPRAHDGPARWAMIRLGGWCARRLCSAAVPAGRRGAAGGLGLAGGRALRVLVDMDGVLADFEGGFLRKFRARFPDQPFIALEDRRGFWVSEQYGRLRPGLSEKAISIWESKNFFFELEPLPGAVEAVKEMASLQNTDVFICTSPIKMFKYCPYEKYAWVEKYFGPDFLEQIVLTRDKTVVSADLLIDDRPDITGAEPTPSWEHVLFTACHNQHLQLQPPRRRLHSWADDWKAILDSKRPC

SEQ ID NO: 871232 - protein, 232 aa, Homo sapiens
GLRSQRAPAGVGVHGPDTFAGLCWIPTKSGPFWKGVRSPHTLRTTPRKYVLGCVFGGVRGMKNHSPYSLAILPKMRAEGAEDPGSNLLFSTSQEKAISIWESKNFFFELEPLPGAVEAVKEMASLQNTDVFICTSPIKMFKYCPYEKYAWVEKYFGPDFLEQIVLTRDKTVVSADLLIDDRPDITGAEPTPSWEHVLFTACHNQHLQLQPPRRRLHSWADDWKAILDSKRPC

SEQ ID NO: 871233 - protein, 575 aa, Homo sapiens
MDERLSLLRSPPPPSARHRAHPPQRPASSGGAHTLVNHGYAEPAAGRELPPDMTVVPGDHLLEPEVADGGGAPPQGGCGGGGCDRYEPLPPSLPAAGEQDCCGERVVINISGLRFETQLKTLCQFPETLLGDPKRRMRYFDPLRNEYFFDRNRPSFDAILYYYQSGGRIRRPVNVPIDIFSEEIRFYQLGEEAMEKFREDEGFLREEERPLPRRDFQRQVWLLFEYPESSGPARGIAIVSVLVILISIVIFCLETLPEFRDEKDYPASTSQDSFEAAGNSTSGSRAGASSFSDPFFVVETLCIIWFSFELLVRFFACPSKATFSRNIMNLIDIVAIIPYFITLGTELAERQGNGQQAMSLAILRVIRLVRVFRIFKLSRHSKGLQILGQTLKASMRELGLLIFFLFIGVILFSSAVYFAEADDPTSGFSSIPDAFWWAVVTMTTVGYGDMHPVTIGGKIVGSLCAIAGVLTIALPVPVIVSNFNYFYHRETEGEEQSQYMHVGSCQHLSSSAEELRKARSNSTLSKSEYMVIEEGGMNHSAFPQTPFKTGNSTATCTTNNNPNSCVNIKKIFTDV

SEQ ID NO: 871234 - protein, 130 aa, Homo sapiens
STVCLSQATNAKLCKTVGCFLGPKNKASLTQVFFNVWSCIYLRYMIFQAVVEAKKLILGGLEKAEKKEDTRMYLLALKNALLPEGIPSLLKYAEAGEGPISHLATTALQRYDLPFITDEVKSPRIFATFT

SEQ ID NO: 871235 - protein, 894 aa, Homo sapiens
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRFEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 871236 - protein, 217 aa, Homo sapiens
MEAAHFFEGTEKLLEVWFSRQQPDANQGSGDLRTIPRSEWDILLKDVQCSIISVTKTDKQEAYVLSESSMFVSKRRFILKTCGTTLLLKALVPLLKLARDYSGFDSIQSFFYSRKNFMKPSHQGYPHRNFQEEIEFLNAIFPKWEPAYGMGTCLNSDLWVLIISWSSKEVGYQCKSTWNLLVSDRFDPFYLRGVRRGSGRDDESFEQALFQEKGVSH

SEQ ID NO: 871237 - protein, 334 aa, Homo sapiens
MEAAHFFEGTEKLLEVWFSRQQPDANQGSGDLRTIPRSEWDILLKDVQCSIISVTKTDKQEAYVLSESSMFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 871238 - protein, 334 aa, Homo sapiens; identical to SEQ ID NO: 871237

SEQ ID NO: 871239 - protein, 359 aa, Homo sapiens
MEAAHFFEGTEKLLEVWFSRQQPDANQGSGDLRTIPRSEWDILLKDVQCSIISVTKTDKQEAYVLSESSMFVSKRRFILKTCGTTLLLKALVPLLKLARDYSGFDSIQMEFRSCFPGWNAIARSQLTAICTSQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 871240 - protein, 316 aa, Homo sapiens
GGRGPRWGSGAPARVASGRSEWDILLKDVQCSIISVTKTDKQEAYVLSESSMFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 871241 - protein, 217 aa, Homo sapiens
MKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 871242 - protein, 261 aa, Homo sapiens
MVLPFKVYYLNISMALVLTAFTYPSWEVDTDRKLTQSLLTYTKGAQHTERLYLEEGSAEPACVGRRAPENGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 871243 - protein, 296 aa, Homo sapiens
MEAAHFFEGTEKLLEVWFSRQQPDANQGSGDLRTIPRSEWDILLKDVQCSIISVTKTDKQEAYVLSESSMFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQMVPGLNIL

SEQ ID NO: 871244 - protein, 441 aa, Homo sapiens
MEAAHFFEGTEKLLEVWFSRQQPDANQGSGDLRTIPRSEWDILLKDVQCSIISVTKTDKQEAYVLSESSMFVSKRRFILKTCGTTLLLKALVPLLKLARDYSGFDSIQSFFYSRKNFMKPSHQGYPHRNFQEEIEFLNAIFPMEQHMFGAYESDWVLYTLGSRESVSVSRLTGICGGCPRLAFLETVRRGPEGSPTVVCRTRFRAGVVPPFLSPLAVSLDFRRMSNQGQTTDKDTNTKHTQPRQGAPGRRHKTHKEPKTRADTEQQRTQQREATNTDDEQTERVKEKGRGERHRKEEKKAKQKREDETKMEEREGENRKREEKESKEERAKKRGGEERRIKSRRRQEEQEEGRKDSREEEDRDRRAREDEGRLLRAARGKKNRKEARRRAETQTTKNNETTERADKKEKEREEAEDTTRKTQGEKRTEKESKPDKKTKKDQ

SEQ ID NO: 871245 - protein, 334 aa, Homo sapiens; identical to SEQ ID NO: 871237

SEQ ID NO: 871246 - protein, 334 aa, Homo sapiens; identical to SEQ ID NO: 871237

SEQ ID NO: 871247 - protein, 334 aa, Homo sapiens; identical to SEQ ID NO: 871237

SEQ ID NO: 871248 - protein, 334 aa, Homo sapiens; identical to SEQ ID NO: 871237

SEQ ID NO: 871249 - protein, 265 aa, Homo sapiens
MFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 871250 - protein, 305 aa, Homo sapiens
MEAAHFFEGTEKLLEVWFSRQQPDANQGSGDLRTIPSESSMFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 871251 - protein, 111 aa, Homo sapiens
SLSILNTVNFFSQGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 871252 - protein, 122 aa, Homo sapiens
MEAAHFFEGTEKLLEVWFSRQQPDANQGSGDLRTIPRWVPGALADIRAWGLSPPPRHQPRVEPEFPQLSVGGKSAAWGRFGGLGRCAVWGRAAMSTRAGAGFSRRGCRAWHCPGGGEEAGAA

SEQ ID NO: 871253 - protein, 70 aa, Homo sapiens
MTVAPTDVMVWMDLRGRISKVLACLNDSSFPYLSFAAPGLSFQLLPLTCTSQVPDKALVFINPNAYTWVL

SEQ ID NO: 871254 - protein, 87 aa, Homo sapiens
AGVRRPSRPPAPPQIASEVAWPWSAGENRTPARLPESGACRGLALRTPRERPGAAYHPDPPHLESAFTAPLFSPLPIWKGSECHFRH

SEQ ID NO: 871255 - protein, 48 aa, Homo sapiens
GGAMLSCFRLLSRHISPSLASLRPVRCCFALPLRWAPGRPLDPRQIAP

SEQ ID NO: 871256 - protein, 331 aa, Homo sapiens
MLLLINVILTLWVSCANGQEVKPCDFPEIQHGGLYYKSLRRLYFPAAAGQSYSYYCDQNFVTPSGSYWDYIHCTQDGWLPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 871257 - protein, 100 aa, Homo sapiens
LDRPAELRPGEPSFRGTFRRRRAASEARAGHERAERRRRLRAGAAAALPRKGRTRRRARRASRRRRLRHGRATLQRGGFGAGAGRAVRSGRGAADRHRRP

SEQ ID NO: 871258 - protein, 1204 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871259 - protein, 905 aa, Homo sapiens
MSAQWCHETRPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871260 - protein, 761 aa, Homo sapiens
MEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871261 - protein, 493 aa, Homo sapiens
MGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871262 - protein, 611 aa, Homo sapiens
MRGLVRGGIVRVQGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871263 - protein, 1204 aa, Homo sapiens; identical to SEQ ID NO: 871258

SEQ ID NO: 871264 - protein, 1204 aa, Homo sapiens; identical to SEQ ID NO: 871258

SEQ ID NO: 871265 - protein, 1204 aa, Homo sapiens; identical to SEQ ID NO: 871258

SEQ ID NO: 871266 - protein, 554 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPPHGHTSSSTAV

SEQ ID NO: 871267 - protein, 106 aa, Homo sapiens
MCAGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871268 - protein, 263 aa, Homo sapiens
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTLCAFAVEGPRGAILTLRPAAMMVLTSGGRSGHCRGRAILGGPPPCSAGTLVAFFLLCTGKRGVHFPVLTEANLAFPDCKQGSAPEASLSVVGERRVHSVGQRA

SEQ ID NO: 871269 - protein, 800 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKVGPATVPPSPLPAISSEPHDRAGKTLTDPTSHFIDRITEAWSHVGSHSKVGRILTPPFPAPCSLGSLRFCPHHPAQPHQAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGRTERGAGS

SEQ ID NO: 871270 - protein, 1174 aa, Homo sapiens
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871271 - protein, 152 aa, Homo sapiens
LTSGARSGHCRGRAMLGGPPPCSAGTLVAFFRLAHPGPECGPPAATDSHSCPHGSPCNDHCDLADPAGPGPAAAPLHQGRLAASDSHEDRRSHCEGGRSQSPGLWHHCADRAFADPGEWRNHLGNSPTGRRCGEAAYQPARSMVNNVTAIYQ

SEQ ID NO: 871272 - protein, 1143 aa, Homo sapiens
MLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871273 - protein, 1283 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKVGPATVPPSPLPAISSEPHDRAGKTLTDPTSHFIDRITEAWSHVGSHSKVGRILTPPFPAPCSLGSLRFCPHHPAQPHQAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871274 - protein, 1123 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGEGAAADQGCAVCSAGKGAHGM

SEQ ID NO: 871275 - protein, 649 aa, Homo sapiens
SVQKFDLGIPRALNAPIHLLKRLQAFGSGYRGVVVLKDANNIQRRGIVRVQGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSRLDPVSPASAPLSLATLVPCSFCPASKL

SEQ ID NO: 871276 - protein, 1204 aa, Homo sapiens; identical to SEQ ID NO: 871258

SEQ ID NO: 871277 - protein, 1204 aa, Homo sapiens; identical to SEQ ID NO: 871258

SEQ ID NO: 871278 - protein, 1143 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGVLCLQLMDVLTSESAWALPQHLGKGFPSPSGHKVPGWHGRMD

SEQ ID NO: 871279 - protein, 615 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVLSLLT

SEQ ID NO: 871280 - protein, 430 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSSESWLY

SEQ ID NO: 871281 - protein, 878 aa, Homo sapiens
TRAHTRDGKSRPEPLEGAGTATLIRAQMAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQPFSQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 871282 - protein, 878 aa, Homo sapiens; identical to SEQ ID NO: 871281

SEQ ID NO: 871283 - protein, 878 aa, Homo sapiens; identical to SEQ ID NO: 871281

SEQ ID NO: 871284 - protein, 878 aa, Homo sapiens; identical to SEQ ID NO: 871281

SEQ ID NO: 871285 - protein, 1016 aa, Homo sapiens
TRAHTRDGKSRPEPLEGAGTATLIRAQMAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQPFSQDPTQLAEMIFNLLLEEKRILIQAQRAQLEQGEPVLETPVESQQHEIESRILDLRAMMEKLVKSISQLKDQQDVFCFRYKIQAKGRKHIEGLEKDKCLLEKPELEVNRRKLQMSSSHCQTHPTDYSPAAVQSWKCFVEAELEVQLRDSKCGGNAWKTNSVLFEGVSGPSMTIQNLPEGPTGACDFAWFPFLPPQNSSFLTLTETPVRKERKEPWTDSCSHHPGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 871286 - protein, 393 aa, Homo sapiens
MNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 871287 - protein, 334 aa, Homo sapiens
MSVAICPTGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 871288 - protein, 274 aa, Homo sapiens [sequence omitted]

SEQ ID NO: 871289 - protein, 393 aa, Homo sapiens; identical to SEQ ID NO: 871286

SEQ ID NO: 871290 - protein, 744 aa, Homo sapiens
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQPFSQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELDGIGPWWGAQTQDRTPFLSSIPSCLG

SEQ ID NO: 871291 - protein, 292 aa, Homo sapiens
GAGCWAVSHSCSLCSRRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 871292 - protein, 191 aa, Homo sapiens
TRAHTRDGKSRPEPLEGAGTATLIRAQMAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQPFSQDPTQLAEMIFNLLLEEKRILIQAQRAQLEQGEPVLETPVESQQHEIESRILDLRAMMEVSRCGRS

SEQ ID NO: 871293 - protein, 191 aa, Homo sapiens; identical to SEQ ID NO: 871292

SEQ ID NO: 871294 - protein, 191 aa, Homo sapiens; identical to SEQ ID NO: 871292

SEQ ID NO: 871295 - protein, 878 aa, Homo sapiens; identical to SEQ ID NO: 871281

SEQ ID NO: 871296 - protein, 878 aa, Homo sapiens; identical to SEQ ID NO: 871281

SEQ ID NO: 871297 - protein, 671 aa, Homo sapiens
MPGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 871298 - protein, 274 aa, Homo sapiens [sequence omitted]

SEQ ID NO: 871299 - protein, 393 aa, Homo sapiens; identical to SEQ ID NO: 871286

SEQ ID NO: 871300 - protein, 274 aa, Homo sapiens [sequence omitted]

SEQ ID NO: 871301 - protein, 274 aa, Homo sapiens [sequence omitted]

SEQ ID NO: 871302 - protein, 191 aa, Homo sapiens; identical to SEQ ID NO: 871292

SEQ ID NO: 871303 - protein, 191 aa, Homo sapiens; identical to SEQ ID NO: 871292

SEQ ID NO: 871304 - protein, 390 aa, Homo sapiens
MADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 871305 - protein, 660 aa, Homo sapiens
PIRTSKRAPVPQTRTVRLQTAPRNSVASRRPRACAFRCLRLRLRLRRSPGRRLSTSSGRCRRSLASPERGTWVSRVADTLPATRATMLMSRTAIPDKVSLCRPRLECSGVISACCNLTSRVQAILLPQPPECWDYRHPPPSEPCPPTDEQLVAGFSDVILATILATKSEMCGQKFELKIDNVRFVGHPTLLQHALGQISKTDPSPKREAPTMILFNVVFALRANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 871306 - protein, 466 aa, Homo sapiens
MCGQKFELKIDNVRFVGHPTLLQHALGQANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 871307 - protein, 335 aa, Homo sapiens
LEDLNSAPQPPRGIELEAESIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 871308 - protein, 660 aa, Homo sapiens; identical to SEQ ID NO: 871305

SEQ ID NO: 871309 - protein, 483 aa, Homo sapiens
PIRTSKRAPVPQTRTVRLQTAPRNSVASRRPRACAFRCLRLRLRLRRSPGRRLSTSSGRCRRSLASPERGTWVSRVADTLPATRATMLMSRTAIPDKVSLCRPRLECSGVISACCNLTSRVQAILLPQPPECWDYRHPPPSEPCPPTDEQLVAGFSDVILATILATKSEMCGQKFELKIDNVRFVGHPTLLQHALGQISKTDPSPKREAPTMILFNVVFALRANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETPMSA

SEQ ID NO: 871310 - protein, 660 aa, Homo sapiens; identical to SEQ ID NO: 871305

SEQ ID NO: 871311 - protein, 660 aa, Homo sapiens; identical to SEQ ID NO: 871305

SEQ ID NO: 871312 - protein, 154 aa, Homo sapiens
MRCPPWLMEMKVLSPHSITSCPSASWPGTSRKLMTASSDDMTLTSPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 871313 - protein, 115 aa, Homo sapiens
RGGGQPQSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 871314 - protein, 660 aa, Homo sapiens; identical to SEQ ID NO: 871305

SEQ ID NO: 871315 - protein, 390 aa, Homo sapiens; identical to SEQ ID NO: 871304

SEQ ID NO: 871316 - protein, 660 aa, Homo sapiens; identical to SEQ ID NO: 871305

SEQ ID NO: 871317 - protein, 724 aa, Homo sapiens
PIRTSKRAPVPQTRTVRLQTAPRNSVASRRPRACAFRCLRLRLRLRRSPGRRLSTSSGRCRRSLASPERGTWVSRVADTLPATRATMLMSRTAIPDKVSLCRPRLECSGVISACCNLTSRVQAILLPQPPECWDYRHPPPSEPCPPTDEQLVAGFSDVILATILATKSEMCGQKFELKIDNVRFVGHPTLLQHALGQISKTDPSPKREAPTMILFNVVFALRANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLPLRPGIGWMRAGRGPVKPAEPRCPCPWWFRCGAAALCVPTLPSSPCRTRRHLHAGGGPARTPVSG

SEQ ID NO: 871318 - protein, 660 aa, Homo sapiens; identical to SEQ ID NO: 871305

SEQ ID NO: 871319 - protein, 660 aa, Homo sapiens; identical to SEQ ID NO: 871305

SEQ ID NO: 871320 - protein, 628 aa, Homo sapiens
PIRTSKRAPVPQTRTVRLQTAPRNSVASRRPRACAFRCLRLRLRLRRSPGRRLSTSSGRCRRSLASPERGTWVSRVADTLPATRATMLMSRTAIPDKVSLCRPRLECSGVISACCNLTSRVQAILLPQPPECWDYRHPPPSEPCPPTDEQLVAGFSDVILATILATKSEMCGQKFELKIDNVRFVGHPTLLQHALGQISKTDPSPKREAPTMILFNVVFALRANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 871321 - protein, 400 aa, Homo sapiens
PIRTSKRAPVPQTRTVRLQTAPRNSVASRRPRACAFRCLRLRLRLRRSPGRRLSTSSGRCRRSLASPERGTWVSRVADTLPATRATMLMSRTAIPDKVSLCRPRLECSGVISACCNLTSRVQAILLPQPPECWDYRHPPPSEPCPPTDEQLVAGFSDVILATILATKSEMCGQKFELKIDNVRFVGHPTLLQHALGQISKTDPSPKREAPTMILFNVVFALRANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDALLPPRLP

SEQ ID NO: 871322 - protein, 68 aa, Homo sapiens
MGSRRPAHPCWGAVVAASLAFTTSSVQACGQLRADSQQWLFSRGLWGLVSGWAHTHPSLPGSFTTSAA

SEQ ID NO: 871323 - protein, 658 aa, Homo sapiens [sequence omitted]

SEQ ID NO: 871324 - protein, 658 aa, Homo sapiens [sequence omitted]

SEQ ID NO: 871325 - protein, 640 aa, Homo sapiens
MVPRLLLRAWPRGPAVGPGAPSRPLSAGSGPGQYLQRSIVPTMHYQDSLPRLPIPKLEDTIRRYLSAQKPLLNDGQFRKTEQFCKSFENGIGKELHEQLVALDKQNKHTSYISGPWFDMYLSARDSVVLNFNPFMAFNPDPKSEYNDQLTRATNMTVSAIRFLKTLRAGLLEPEVFHLNPAKSDTITFKRLIRFVPSSLSWYGAYLVNAYPLDMSQYFRLFNSTRLPKPSRDELFTDDKARHLLVLRKGNFYIFDVLDQDGNIVSPSEIQAHLKYILSDSSPAPEFPLAYLTSENRDIWAELRQKLMSSGNEESLRKVDSAVFCLCLDDFPIKDLVHLSHNMLHGDGTNRWFDKSFNLIIAKDGSTAIHFEHSWGDGVAVLRFFNEVFKDSTQTPAVTPQSQPATTDSTVTVQKLNFELTDALKTGITAAKEKFDATMKTLTIDCVQFQRGGKEFLKKRQYGQTVATYESCSTAAFKHGRTETIRPASVYTKRCSEAFVREPSRHSAGELQQMMVECSKYHGQLTKEAAMGQGFDRHLFALRHLAAAKGIILPELYLDPAYGQINHNVLSTSTLSSPAVNLGGFAPVVSDGFGVGYAVHDNWIGCNVSSYPGRNAREFLQCVEKALEDMFDALEGKSIKS

SEQ ID NO: 871326 - protein, 673 aa, Homo sapiens
FIALGYRREFPGRTHASARLLLRAWPRGPAVGPGAPSRPLSAGSGPGQYLQRSIVPTMHYQDSLPRLPIPKLEDTIRRYLSAQKPLLNDGQFRKTEQFCKSFENGIGKELHEQLVALDKQNKHTSYISGPWFDMYLSARDSVVLNFNPFMAFNPDPKSEYNDQLTRATNMTVSAIRFLKTLRAGLLEPEVFHLNPAKSDTITFKRLIRFVPSSLSWYGAYLVNAYPLDMSQYFRLFNSTRLPKPSRDELFTDDKARHLLVLRKGNFYIFDVLDQDGNIVSPSEIQAHLKYILSDSSPAPEFPLAYLTSENRDIWAELRQKLMSSGNEESLRKVDSAVFCLCLDDFPIKDLVHLSHNMLHGDGTNRWFDKSFNLIIAKDGSTAIHFEHSWGDGVAVLRFFNEVFKDSTQTPAVTPQSQPATTDSTVTVQKLNFELTDALKTGITAAKEKFDATMKTLTIDCVQFQRGGKEFLKKQKLSPDAVAQLAFQMAFLRQYGQTVATYESCSTAAFKHGRTETIRPASVYTKRCSEAFVREPSRHSAGELQQMMVECSKYHGQLTKEAAMGQGFDRHLFALRHLAAAKGIILPELYLDPAYGQINHNVLSTSTLSSPAVNLGGFAPVVSDGFGVGYAVHDNWIGCNVSSYPGRNAREFLQCVEKALEDMFDALEGKSIKS

SEQ ID NO: 871327 - protein, 549 aa, Homo sapiens
MASSGPWFDMYLSARDSVVLNFNPFMAFNPDPKSEYNDQLTRATNMTVSAIRFLKTLRAGLLEPEVFHLNPAKSDTITFKRLIRFVPSSLSWYGAYLVNAYPLDMSQYFRLFNSTRLPKPSRDELFTDDKARHLLVLRKGNFYIFDVLDQDGNIVSPSEIQAHLKYILSDSSPAPEFPLAYLTSENRDIWAELRQKLMSSGNEESLRKVDSAVFCLCLDDFPIKDLVHLSHNMLHGDGTNRWFDKSFNLIIAKDGSTAIHFEHSWGDGVAVLRFFNEVFKDSTQTPAVTPQSQPATTDSTVTVQKLNFELTDALKTGITAAKEKFDATMKTLTIDCVQFQRGGKEFLKKQKLSPDAVAQLAFQMAFLRQYGQTVATYESCSTAAFKHGRTETIRPASVYTKRCSEAFVREPSRHSAGELQQMMVECSKYHGQLTKEAAMGQGFDRHLFALRHLAAAKGIILPELYLDPAYGQINHNVLSTSTLSSPAVNLGGFAPVVSDGFGVGYAVHDNWIGCNVSSYPGRNAREFLQCVEKALEDMFDALEGKSIKS

SEQ ID NO: 871328 - protein, 658 aa, Homo sapiens [sequence omitted]

SEQ ID NO: 871329 - protein, 666 aa, Homo sapiens
MVPRLLLRAWPRGPAVGPGAPSRPLSAGSGPGQYLQRSIVPTMHYQDSLPSAAIFSARTCKRHLVEVDSLKLPRGSLSCNDGLVPRKTEQFCKSFENGIGKELHEQLVALDKQNKHTSYISGPWFDMYLSARDSVVLNFNPFMAFNPDPKSEYNDQLTRATNMTVSAIRFLKTLRAGLLEPEVFHLNPAKSDTITFKRLIRFVPSSLSWYGAYLVNAYPLDMSQYFRLFNSTRLPKPSRDELFTDDKARHLLVLRKGNFYIFDVLDQDGNIVSPSEIQAHLKYILSDSSPAPEFPLAYLTSENRDIWAELRQKLMSSGNEESLRKVDSAVFCLCLDDFPIKDLVHLSHNMLHGDGTNRWFDKSFNLIIAKDGSTAIHFEHSWGDGVAVLRFFNEVFKDSTQTPAVTPQSQPATTDSTVTVQKLNFELTDALKTGITAAKEKFDATMKTLTIDCVQFQRGGKEFLKKQKLSPDAVAQLAFQMAFLRQYGQTVATYESCSTAAFKHGRTETIRPASVYTKRCSEAFVREPSRHSAGELQQMMVECSKYHGQLTKEAAMGQGFDRHLFALRHLAAAKGIILPELYLDPAYGQINHNVLSTSTLSSPAVNLGGFAPVVSDGFGVGYAVHDNWIGCNVSSYPGRNAREFLQCVEKALEDMFDALEGKSIKS

SEQ ID NO: 871330 - protein, 159 aa, Homo sapiens
ATLTSSFDLAYMTSGHPATATSSFDLAYMTSGHPATPTSSFDLPYVTSGHPATPTSSFDLPYVTSGHPATATSSFDLAYVTSGHPATPTSSFDLPYVTSGHPATATSSFDLPYVTSGHPATATSSFDLAYVTSGHPATATSSFDLPYVTSGHPATPTSS

SEQ ID NO: 871331 - protein, 585 aa, Homo sapiens
MDLPGDSSPPGQPRLCRQPLTRALWGARSPKRPRLQLPGAPSPLEKASRRVLAVVLEDVMAVHMVPVVPSKQTSIPQHHSYHQDPVHRQPPASPPRQAGWSSQARPPDPLCLCREPLSRIHRTSSTLRRRSRTTPGPEEGPSQKVDRAPQPTLVVMLEDIASPRPPAEGFIDETPNFIIPAQRAEPMRIVRQPTPPPGDLEPPFQPSALPADPLESPPTAPDPALELPSTPPPSSLLRPRLSPWGLAPLFRSVRSKLESFADIFLTPNKNPQPPPPSPPMKLELKIAISEAEQSGAAEGTASVSPRPPIRQWRTQDHNTPALLPKPSLGRSYSCPDLGPPGPGTCTWPPAPPQPSRPRPRRHTVGGGEMARAPPPPRPCLRKEVFPLGGVGASPSLTTSCSSTASTSFSEPAEPRLGSTKGKEPRASKDQVLSEPETKTMGKVSRFRIRRTPARPQLNLTPMGLPRPIRLNKKEFSLEEIYTNKNYQSPTTRRTFETIFEEPRERNGTLIFTSSRKLRRAVEFRDSSLPRSRRPSRGVRAAGGRTVPPNVAPSPDVGPLLQQRLEELDALLLEEETVDREQPHWT

SEQ ID NO: 871332 - protein, 430 aa, Homo sapiens
MLEDIASPRPPAEGFIDETPNFIIPAQRAEPMRIVRQPTPPPGDLEPPFQPSALPADPLESPPTAPDPALELPSTPPPSSLLRPRLSPWGLAPLFRSVRSKLESFADIFLTPNKNPQPPPPSPPMKLELKIAISEAEQSGAAEGTASVSPRPPIRQWRTQDHNTPALLPKPSLGRSYSCPDLGPPGPGTCTWPPAPPQPSRPRPRRHTVGGGEMARAPPPPRPCLRKEVFPLGGVGASPSLTTSCSSTASTSFSEPAEPRLGSTKGKEPRASKDQVLSEPETKTMGKVSRFRIRRTPARPQLNLTPMGLPRPIRLNKKEFSLEEIYTNKNYQSPTTRRTFETIFEEPRERNGTLIFTSSRKLRRAVEFRDSSLPRSRRPSRGVRAAGGRTVPPNVAPSPDVGPLLQQRLEELDALLLEEETVDREQPHWT

SEQ ID NO: 871333 - protein, 585 aa, Homo sapiens; identical to SEQ ID NO: 871331

SEQ ID NO: 871334 - protein, 585 aa, Homo sapiens; identical to SEQ ID NO: 871331

SEQ ID NO: 871335 - protein, 585 aa, Homo sapiens; identical to SEQ ID NO: 871331

SEQ ID NO: 871336 - protein, 430 aa, Homo sapiens; identical to SEQ ID NO: 871332

SEQ ID NO: 871337 - protein, 430 aa, Homo sapiens; identical to SEQ ID NO: 871332

SEQ ID NO: 871338 - protein, 306 aa, Homo sapiens [sequence omitted]

SEQ ID NO: 871339 - protein, 146 aa, Homo sapiens
MGKVSRFRIRRTPARPQLNLTPMGLPRPIRLNKKEFSLEEIYTNKNYQSPTTRRTFETIFEEPRERNGTLIFTSSRKLRRAVEFRDSSLPRSRRPSRGVRAAGGRTVPPNVAPSPDVGPLLQQRLEELDALLLEEETVDREQPHWT

SEQ ID NO: 871340 - protein, 514 aa, Homo sapiens
MDLPGDSSPPGQPRLCRQPLTRALWGARSPKRPRLQLPGAPSPLEKASRRVLAVVLEDVMAVHMVPVVPSKQTSIPQHHSYHQDPVHRQPPASPPRQAGWSSQARPPDPLCLCREPLSRIHRTSSTLRRRSRTTPGPEEGPSQKVDRAPQPTLVVMLEDIASPRPPAEGFIDETPNFIIPAQRAEPMRIVRQPTPPPGDLEPPFQPSALPADPLESPPTAPDPALELPSTPPPSSLLRPRLSPWGLAPLFRSVRSKLESFADIFLTPNKNPQPENTTRQKRHMTADTTHPPTHPRKTTQTASSAKKETQKRTNSDTNHRHTATNHQPTTQQRKKATKENNRRRKHKTSTRNHDTHPNKNNEHNTKANERRTHNRTKNRRNRHSETTKAQGRTRDNQRAKQKQNHRQNTPQRNIHTANHNRQRTTEQRTTDNSQPNQNNTKNQKQENTQRTRKQEERRRRRDNTERNDDTRTDNRTKKSDHQAQHKEQRAKTKRKKTNTAHQKDNKEKSENPPHT

SEQ ID NO: 871341 - protein, 354 aa, Homo sapiens
MGVAGSGGIPGSSPSLYLALHPRAEPMRIVRQPTPPPGDLEPPFQPSALPADPLESPPTAPDPALELPSTPPPSSLLRPRLSPWGLAPLFRSVRSKLESFADIFLTPNKNPQPENTTRQKRQMTADTTHPPTHPRKTTQTASSAKKETQKRTNSDTNHRHTATNHQPTTQQRKKATKENNRRRKHKTSTRNHDTHPNKNNEHNTKANERRTHNRTKNRRNRHSETTKAQGRTRDNQRAKQKQNHRQNTPQRNIHTANHNRQRTTEQRTTDNSQPNQNNTKNQKQENTQRTRKQEERRRRRDNTERNDDTRTDNRTKKSDHQAQHKEQRAKTKRKKTNTAHQKDNKEKSENPPHT

SEQ ID NO: 871342 - protein, 585 aa, Homo sapiens; identical to SEQ ID NO: 871331

SEQ ID NO: 871343 - protein, 384 aa, Homo sapiens
MDLPGDSSPPGQPRLCRQPLTRALWGARSPKRPRLQLPGAPSPLEKASRRVLAVVLEDVMAVHMVPVVPSKQTSIPQHHSYHQDPVHRQPPASPPRQAGWSSQARPPDPLCLCREPLSRIHRTSSTLRRRSRTTPGPEEGPSQKVDRAPQPTLVVMLEDIASPRPPAEGFIDETPNFIIPAQRAEPMRIVRQPTPPPGDLEPPFQPSALPADPLESPPTAPDPALELPSTPPPSSLLRPRLSPWGLAPLFRSVRSKLESFADIFLTPNKNPQPPPPSPPMKLELKIAISEAEQSGAAEGTASVSPRPPIRQWRTQDHNTPALLPKPSLGRSYSCPDLGPPGPGWVQPKGRSQEPQRTRCFQNLRPRPWERFLDSEYAEHQPVLS

SEQ ID NO: 871344 - protein, 399 aa, Homo sapiens
MRIVRQPTPPPGDLEPPFQPSALPADPLESPPTAPDPALELPSTPPPSSLLRPRLSPWGLAPLFRSVRSKLESFADIFLTPNKNPQPPPPSPPMKLELKIAISEAEQSGAAEGTASVSPRPPIRQWRTQDHNTPALLPKPSLGRSYSCPDLGPPGPGTCTWPPAPPQPSRPRPRRHTVGGGEMARAPPPPRPCLRKEVFPLGGVGASPSLTTSCSSTASTSFSEPAEPRLGSTKGKEPRASKDQVLSEPETKTMGKVSRFRIRRTPARPQLNLTPMGLPRPIRLNKKEFSLEEIYTNKNYQSPTTRRTFETIFEEPRERNGTLIFTSSRKLRRAVEFRDSSLPRSRRPSRGVRAAGGRTVPPNVAPSPDVGPLLQQRLEELDALLLEEETVDREQPHWT

SEQ ID NO: 871345 - protein, 430 aa, Homo sapiens; identical to SEQ ID NO: 871332

SEQ ID NO: 871346 - protein, 192 aa, Homo sapiens
KPSLPNAAQPPMAFFSEPAEPRLGSTKGKEPRASKDQVLSEPETKTMGKVSRFRIRRTPARPQLNLTPMGLPRPIRLNKKEFSLEEIYTNKNYQSPTTRRTFETIFEEPRERNGTLIFTSSRKLRRAVEFRDSSLPRSRRPSRGVRAAGGRTVPPNVAPSPDVGPLLQQRLEELDALLLEEETVDREQPHWT

SEQ ID NO: 871347 - protein, 136 aa, Homo sapiens
MKLELKIAISEAEQSGAAEGTASVSPRPPIRQWRTQDHNTPALLPKPSLGRSYSCPDLGPPGPGTCTWPPAPPQPSRPRPRRHTVGGGEMARAPPPPRPCLRKEVFPLGGVGASPSLTTSCSSTASTSFSEPAEPR

SEQ ID NO: 871348 - protein, 190 aa, Homo sapiens
AAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQTQHGGAKDSAAGGQADPPGPPLLSKPGDEDDAPPKMGEPAGG

SEQ ID NO: 871349 - protein, 224 aa, Homo sapiens
ERLGSLYAEAVVTQAQLTVAEAQLTRTGDGGVLVLPLSPPPLSSLAGLAESPPKNPRSHILKTMSGSFYFVIVGHHDNPVFEMEFLPAGKAESKDDHRHLNQFIAHAALDLVDENMWLSNNMYLKTVDKFNEWFVSAFVTAGHMRFIMLHDIRQEDGIKNFFTDVYDLYIKDKNDGHTRTSLPDVYDFILQTFSMNPFYEPNSPIRSSAFDRKVQFLGKKHLLS

SEQ ID NO: 871350 - protein, 140 aa, Homo sapiens [sequence omitted]

SEQ ID NO: 871351 - protein, 174 aa, Homo sapiens
RRSGYRFGARVSSAETDIAFPLSASHCRSHILKTMSGSFYFVIVGHHDNPVFEMEFLPAGKAESKDDHRHLNQFIAHAALDLVDENMWLSNNMYLKTVDKFNEWFVSAFVTAGHMRFIMLHDIRQEDGIKNFFTDVYDLYIKFSMNPFYEPNSPIRSSAFDRKVQFLGKKHLLS

SEQ ID NO: 871352 - protein, 140 aa, Homo sapiens [sequence omitted]

SEQ ID NO: 871353 - protein, 140 aa, Homo sapiens [sequence omitted]

SEQ ID NO: 871354 - protein, 262 aa, Homo sapiens
TARYEAWVAGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNASAFVHRCGRTARIGHGGSALVFLLPMEESYSYCNTKSL

SEQ ID NO: 871355 - protein, 453 aa, Homo sapiens
MFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNASAFVHRCGRTARIGHGGSALVFLLPMEESYINFLAINQKCPLQEMKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 871356 - protein, 453 aa, Homo sapiens; identical to SEQ ID NO: 871355

SEQ ID NO: 871357 - protein, 612 aa, Homo sapiens
RAAATDAAKERAMEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNASAFVHRCGRTARIGHGGSALVFLLPMEESYINFLAINQKCPLQEMKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 871358 - protein, 612 aa, Homo sapiens; identical to SEQ ID NO: 871357

SEQ ID NO: 871359 - protein, 557 aa, Homo sapiens
MRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNASAFVHRCGRTARIGHGGSALVFLLPMEESYINFLAINQKCPLQEMKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 871360 - protein, 453 aa, Homo sapiens; identical to SEQ ID NO: 871355

SEQ ID NO: 871361 - protein, 636 aa, Homo sapiens
RAAATDAAKERAMEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNASAFVHRCGRTARIGHGGSALVFLLPMEESYINFLAINQKVVMGSPGDMMPAREGENVVCVCVYCPLQEMKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 871362 - protein, 207 aa, Homo sapiens
MKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 871363 - protein, 372 aa, Homo sapiens
RAAATDAAKERAMEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNARFSTGDYVPPV

SEQ ID NO: 871364 - protein, 69 aa, Homo sapiens
ICTPLSQKREEGSDIEDEDMEELLNDTRLLKKLKKGKITEEEFEKGLLTTGKRTIKTVDLGISDLEDDC

SEQ ID NO: 871365 - protein, 453 aa, Homo sapiens; identical to SEQ ID NO: 871355

SEQ ID NO: 871366 - protein, 453 aa, Homo sapiens; identical to SEQ ID NO: 871355

SEQ ID NO: 871367 - protein, 475 aa, Homo sapiens
TARYEAWVAGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNASAFVHRCGRTARIGHGGSALVFLLPMEESYINFLAINQKCPLQEMKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 871368 - protein, 363 aa, Homo sapiens
RAAATDAAKERAMEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNARS

SEQ ID NO: 871369 - protein, 355 aa, Homo sapiens
RAAATDAAKERAMEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQRWVGFIEGSSSPATLLFQVPKCPIL

SEQ ID NO: 871370 - protein, 136 aa, Homo sapiens
SHGDYYCQICFLLVSLFILQVCKADEKFNQLVHFLRNHKQEKHLVFFRYSSGLCGRGIRDSARMCRCMRPLGFGFHLAWFSPECFWLQITENPTFVVRTRLALFFSRKKSSKGRQFLTWVSCVSHVKVNVDVIGLL

SEQ ID NO: 871371 - protein, 486 aa, Homo sapiens
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAALARSAFSYYKSTSSAFRKSPSLAAFLANPRGFYRPGARGDHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDAKQFPPTVSLPLKTSRPLSP

SEQ ID NO: 871372 - protein, 486 aa, Homo sapiens; identical to SEQ ID NO: 871371

SEQ ID NO: 871373 - protein, 486 aa, Homo sapiens; identical to SEQ ID NO: 871371

SEQ ID NO: 871374 - protein, 102 aa, Homo sapiens
KWGPQTNASQPPGFSPLPRGMYGPPVLLKILSQRNYWLQHHQITNVLPMKSRHLGLPGLAFVSIGSSCCNVRSPGSFSWKKDHVKKRVVRCDEEAIADTQPC

SEQ ID NO: 871375 - protein, 102 aa, Homo sapiens; identical to SEQ ID NO: 871374

SEQ ID NO: 871376 - protein, 102 aa, Homo sapiens; identical to SEQ ID NO: 871374

SEQ ID NO: 871377 - protein, 2352 aa, Homo sapiens
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKEQKREERRQLKQQLEDMQKQLRQVQEKFYQIYDSTDSENDEDGNLSEDSMRSEILDARAQDSVGRSDNEMCELDPGQFIDRARALIREQEMAENKPKREGNNKERDHGPNSLQPEGKHLAETLKQELNTAMSQVVDTVVKVFSAKPSRQVPQVFPPLQIPQARFAVNGENHNFHTANQRLQCFGDVIIPNPLDTFGNVQMASSTDQTEALPLVVRKNSSDQSASGLVGGHHQPLHQSPLSATTGFTTSTFRHPFPLPLMAYPFQSPLGAPSGSFSGKDRASPESLDLTRDTTSLRTKMSSHHLSHHPCSPAHPPSTAEGLSLSLIKSECGDLQDMSEISPYSGSAMQEGLSPNHLKKAKLMFFYTRYPSSNMLKTYFSDVKFNRCITSQLIKWFSNFREFYYIQMEKYARQAINDGVTSTEELSITRDCELYRALNMHYNKANDFEVPERFLEVAQITLREFFNAIIAGKDVDPSWKKAIYKVICKLDSEVPEIFKSPNCLQELLHEVEISTTLFECMKSSSPFGCPSYMCLDFDFIYMCMGGMDMLCNQLVIPPHHVSLIFFCFPLQGDGCFLSAFSLLLPKALNIWTLKIGLIFREKDVGVCKVSISNEGNLLTMHPLDVMTYCKWRLAEENPCHSTTLQTVMCLLFLLLRRSENLMKPLHTFKYFVWFELNQQLFLTCLKIIPMTDEQLTFPKYPKRPNYKKKNNHSQALSEEKRQTLKVVPVSSGGKAILHKTSSLKMRLEIHTWSCSHLSKLENRFFFISELTSFFIKKNPITCYHFCFRYYKALSFQFTLLNFVYMLKRILFDLTIFSPKILFSEYFLPVRNKGKPNLAIKFLPTLEVCGQPLADLIVISYEEHIYFHKQFHTILMGMQSGDSLTQCFFILGKHFKAIDNASSNSEASIDQNVRRVYSIGKFGVNPKDTIPAHIRKLAAILCFLPWFSSFFPFIFPCFSMMYSVPYLHGKNSYGIHTFFLRWVFVSRCSKNSLFILKLFPDPSFPLGNLIYTSKNDTVTNLVFRTYRTEMPFFNSTLIRITFDFGEYQVLTHVTDYADPDRCNLTSFINSADWTGMYELNYCQHKALKPADFKLNGAVPMMPCTIQGTNRASQCRQRVQPHGRGHQPPHSAPAASHISQLTLYYMHRVIRSNLLFFSLALKKSSLDNHDIGIKWEGKIPSAQNREVIPTCSHSFLTGFVLKEDGSPCSCQCATGFLLFRVIHINFVLPFARKRQSCSVFTYVDRLLDIFLIWGEFNIDFQTYLDFFSIIFPSLSNLNRQIKQKCVFINQMLMPLSTDNILSMFTEAEKLFQSRNCSMRINSPLFLKIELYHYAFRWFSLLQSKSCASQVHWKMTKACLSKFLFNSLIFVFLITIFQILAQLSPSENWLLGRKLTFYGGMVKDEGQFTYGKEKKKSKVHVEKPHYHLFSANPKLFLRIRLRLSLCLDLKCTSGGDFKKSFKIPVFSQQVQIVLVPSVAFDFIFLTLFPITTAAINTRFFFWLFDITLIAMHILCLFKTKRENTFLKKRIFRTVRYRKLFFPQLFEQHSSFENSCRSQFFVTVVQILCFLSLMKSSIEAIFHTMCYICVRRCVNIKSHTHIYTHVKIYIYIYACEDGKLTFSYLDLRTYFRHLLCFVKRMFYFNKTFNSYCISGCLMRTFHIKWKNTWKMLECSNYLSKQFTHIFLKFALCLRVLFNERSVLCLQNLCHCTRDVGEYHLKKFKTTKKKQNRNTKDKRGTFIKQCKYLTSWLHYVRHEILINNYILTTSVEFTRNTTVTVRQLKAFLKILLSPFKSKQSLLSDVKGKGNAVSVNFEISFSMYMKTFSKSHPPFPCAHVRIHTHTHTHTHTNTHTVIKANDLGTLKNRMSSRNNHKFMKEREFTDSPERSSVYVKTVQKSLCHVYYSVFIGVNSTNVSFWYKLCVCKFTRSIVFKKLPLKNVTGLYEYSSYRIALKCYVEGNAVLFSVDLLVVNIYKTKAKMLIIQSWDQNWYLTFASSYNYPSKNITECGSVWTLSLFKLSLLSNLTPPQNAQTSAEKANKLTFFCENVFILYFFKYSIPLKMGRKYFKIVYYDFKFRTKKKMYLGLVSALPRRIKGHGFPQYCPSHFSYVYSINRDKTLPLYYLAICCK

SEQ ID NO: 871378 - protein, 1407 aa, Homo sapiens
MRQTLKVVPVSSGGKAILHKTSSLKMRLEIHTWSCSHLSKLENRFFFISELTSFFIKKNPITCYHFCFRYYKALSFQFTLLNFVYMLKRILFDLTIFSPKILFSEYFLPVRNKGKPNLAIKFLPTLEVCGQPLADLIVISYEEHIYFHKQFHTILMGMQSGDSLTQCFFILGKHFKAIDNASSNSEASIDQNVRRVYSIGKFGVNPKDTIPAHIRKLAAILCFLPWFSSFFPFIFPCFSMMYSVPYLHGKNSYGIHTFFLRWVFVSRCSKNSLFILKLFPDPSFPLGNLIYTSKNDTVTNLVFRTYRTEMPFFNSTLIRITFDFGEYQVLTHVTDYADPDRCNLTSFINSADWTGMYELNYCQHKALKPADFKLNGAVPMMPCTIQGTNRASQCRQRVQPHGRGHQPPHSAPAASHISQLTLYYMHRVIRSNLLFFSLALKKSSLDNHDIGIKWEGKIPSAQNREVIPTCSHSFLTGFVLKEDGSPCSCQCATGFLLFRVIHINFVLPFARKRQSCSVFTYVDRLLDIFLIWGEFNIDFQTYLDFFSIIFPSLSNLNRQIKQKCVFINQMLMPLSTDNILSMFTEAEKLFQSRNCSMRINSPLFLKIELYHYAFRWFSLLQSKSCASQVHWKMTKACLSKFLFNSLIFVFLITIFQILAQLSPSENWLLGRKLTFYGGMVKDEGQFTYGKEKKKSKVHVEKPHYHLFSANPKLFLRIRLRLSLCLDLKCTSGGDFKKSFKIPVFSQQVQIVLVPSVAFDFIFLTLFPITTAAINTRFFFWLFDITLIAMHILCLFKTKRENTFLKKRIFRTVRYRKLFFPQLFEQHSSFENSCRSQFFVTVVQILCFLSLMKSSIEAIFHTMCYICVRRCVNIKSHTHIYTHVKIYIYIYACEDGKLTFSYLDLRTYFRHLLCFVKRMFYFNKTFNSYCISGCLMRTFHIKWKNTWKMLECSNYLSKQFTHIFLKFALCLRVLFNERSVLCLQNLCHCTRDVGEYHLKKFKTTKKKQNRNTKDKRGTFIKQCKYLTSWLHYVRHEILINNYILTTSVEFTRNTTVTVRQLKAFLKILLSPFKSKQSLLSDVKGKGNAVSVNFEISFSMYMKTFSKSHPPFPCAHVRIHTHTHTHTHTNTHTVIKANDLGTLKNRMSSRNNHKFMKEREFTDSPERSSVYVKTVQKSLCHVYYSVFIGVNSTNVSFWYKLCVCKFTRSIVFKKLPLKNVTGLYEYSSYRIALKCYVEGNAVLFSVDLLVVNIYKTKAKMLIIQSWDQNWYLTFASSYNYPSKNITECGSVWTLSLFKLSLLSNLTPPQNAQTSAEKANKLTFFCENVFILYFFKYSIPLKMGRKYFKIVYYDFKFRTKKKMYLGLVSALPRRIKGHGFPQYCPSHFSYVYSINRDKTLPLYYLAICCK

SEQ ID NO: 871379 - protein, 1435 aa, Homo sapiens
MSSSLFQSTPKGQIKKEKYITLKPCLRKEANSESRTSFFWRQSNFAQNQLSQDETRNSYLVFSHLSKLENRFFFISELTSFFIKKNPITCYHFCFRYYKALSFQFTLLNFVYMLKRILFDLTIFSPKILFSEYFLPVRNKEKAQLGHKILAYTRSLLTAISCLDRHLLRGTHIFSQAIPHYPDGYAKWCQSNSVFLHFRYNILKAIDNASSNSEASIDQNVRRVYSIGKFGVNPKDTIPAHIRKLAAILCFLPWFSSFFPFIFPCFSMMYSVPYLHWKNSYGIHTFFLRWVFVSRCSKNSLFILKLFSRPFLPLREFDIHLLKYTVTNLVFRTYRTYMPFFNSTLIRITFDFGEYQVLTHVTDYADPDRCNLTSFINSADWTGMYELNYCQHKALKPADFKLNGAVPMMPCTIQGTNRASQCRQRVQPHGRGHQPPHSAPAASHISQLTLYYMHRVIRSNLLFFSLALKKSSLDNHDIGIKWEGKIPSAQNREVIPTCSHSFLTGFVLKEDGSPCSCQCATGFLLFRVIHINFVLPFEGKRQSCSVFTYVDRLLDIFLIWGEFNIDFQTYLDFFSIIFPSLSNLNRQIKQKCVFINQMLMPLSTDNILSMFTEAEKLFQSRNCSMRINSPLCSENRTLSLCFPVVFPFTIEILCLPSALENDKSLSLQIPIKQFDFFFLITIFQILAQLSPSENWLLGRKLTFYGGMVKDEGQFTYGKEKKKSKVHVEKPHYHLFSANPKLFLRIRLRLSLCLDLKCTSGGDFKKSFKIPVFSQQVQIVLVPSVAFDFIFLTLFPITTAAINTRFFFWLFDITLIAMHILCLFKTKRENTFLKKRIFRTVRYRKLFFPQLFEQHSSFENSCRSQFFVTVVQILCFLSLMKSSIEAIFHTMCYICVRRCVNIKSHTHIYTHVKIYIYIYACEDGKLTFSYLDLRTYFRHLLCFVKRMFYFNKTFNSYCISGCLMRTFHIKWYNTWKMLECSNYLSKQFTHIFLKFALCLRVLFNLRSVLCLQNLCHCTRDVGEYHLKKFKTTKKKQNRNTKDKRGTFIKQCKYLTSWLHYVRHEILINNYILTTSVEFTRNTTVTVRQLKAFLKILLSPFKSKQSLLSDVKGKGNAVSEIYEISFSMYMKTFSEVTPPLPMRTCAHTHTHTHTHTHKHTHCHKANDLGTLKNRMSSRNNHKFMKEREFTDSPERSSVYVKTVQKSLCHVYYSVFIGVNSTNVSFWYKLCVCKFTRSIVFKKLPLKNVTGLYEYSSYRIALKCYVEGNAVLFSVDLLVVNIYKTKAKMLIIQSWDQNWYLTFASSYNYPSKNITECGSVWTLSLFKLSLLSNLTPPQNAQTSAEKANKLTFFCENVFILYFFKYSIPLKMGRKYFKIVYYDFKFRTKKKMYLGLVSALPRRIKGHGFPQYCPSHFSYVYSINRDKTLPLYYLAICCK

SEQ ID NO: 871380 - protein, 384 aa, Homo sapiens
MAALTLRGVRELLKRVDLATVPRRHRYKKKWAATEPKFPAVRLALQNFDMTYSVQFGDLWPSIRVSLLSEQKYGALVNNFAAWDHVSAKLEQLSAKDFVNEAISHWELQSEGGQSAAPSPASWACSPNLRCFTFDRGDISRFPPARPGSLGVMEYYLMDAASLLPVLALGLQPGDIVLDLCAAPGGKTLALLQTGCCRNLAANDLSPSRIARLQKILHSYVPEEIRDGNQVRVTSWDGRKWGELEGDTYDRVLVDVPCTTDRHSLHEEENNIFKRSRKKERQILPVLQVQLLAAGLLATKPGGHVVYSTCSLSHLQNEYVVQGAIELLANQYSIQVQVEDLTHFRRVFMDTFCFFSSCQVGELVIPNLMANFGPMYFCKMRRLT

SEQ ID NO: 871381 - protein, 384 aa, Homo sapiens; identical to SEQ ID NO: 871380

SEQ ID NO: 871382 - protein, 344 aa, Homo sapiens
MAALTLRGVRELLKRVDLATVPRRHRYKKKWAATEPKFPAVRLALQNFDMTYSVQFGDLWPSIRVSLLSEQKYGALVNNFAAWDHVSAKLEQLSAKDFVNEAISHWELQSEGGQSAAPSPASWACSPNLRCFTFDRGDISRFPPARPGSLGVMEYYLMDAASLLPVLALGLQPGDIVLDYVPEEIRDGNQVRVTSWDGRKWGELEGDTYDRVLVDVPCTTDRHSLHEEENNIFKRSRKKERQILPVLQVQLLAAGLLATKPGGHVVYSTCSLSHLQNEYVVQGAIELLANQYSIQVQVEDLTHFRRVFMDTFCFFSSCQVGELVIPNLMANFGPMYFCKMRRLT

SEQ ID NO: 871383 - protein, 146 aa, Homo sapiens
MAALTLRGVRELLKRVDLATVPRRHRYKKKWAATEPKFPAVRLALQNFDMTYSVQFGDLWPSIRVSLLSEQKYGALVNNFAAWDHVSAKLEQLSAKDFVNEAISHWELQSEGGQSAAPSPASWACSPNLRCFTFDRGDISRFPPAR

SEQ ID NO: 871384 - protein, 119 aa, Homo sapiens
MAALTLRGVRELLKRVDLATVPRRHRYKKKWPGRPHPSENTIATLPALLGLRRLAGKDSAPSSTSSCLWRPGKVTATTLSILPAQTLAKGATNPLILWTLLASPETLFLASLEALEFLL

SEQ ID NO: 871385 - protein, 344 aa, Homo sapiens; identical to SEQ ID NO: 871382

SEQ ID NO: 871386 - protein, 384 aa, Homo sapiens; identical to SEQ ID NO: 871380

SEQ ID NO: 871387 - protein, 442 aa, Homo sapiens
MAALTLRGVRELLKRVDLATVPRRHRYKKKWPGRPHPSENTIATLLHSWVSAALQERIQPLPQPRAASGDRARLQRPPCPYCRPKPWQKAATEPKFPAVRLALQNFDMTYSVQFGDLWPSIRVSLLSEQKYGALVNNFAAWDHVSAKLEQLSAKDFVNEAISHWELQSEGGQSAAPSPASWACSPNLRCFTFDRGDISRFPPARPGSLGVMEYYLMDAASLLPVLALGLQPGDIVLDLCAAPGGKTLALLQTGCCRNLAANDLSPSRIARLQKILHSYVPEEIRDGNQVRVTSWDGRKWGELEGDTYDRVLVDVPCTTDRHSLHEEENNIFKRSRKKERQILPVLQVQLLAAGLLATKPGGHVVYSTCSLSHLQNEYVVQGAIELLANQYSIQVQVEDLTHFRRVFMDTFCFFSSCQVGELVIPNLMANFGPMYFCKMRRLT

SEQ ID NO: 871388 - protein, 121 aa, Homo sapiens
MCLKRSGMEIKFELPHGMAGNGENWRGTPMTGCWWMCPVPQTATPFMRRRTTSLSGQGRRSDRYCLCCKCSFLRLDSLPPNQEAMLSILPAHSHTYRTSMWCKVPLSSWPINTASRYRWKI

SEQ ID NO: 871389 - protein, 76 aa, Homo sapiens
VPSRYAAPLPLTCQDAQVHCHNPFQKTLVAAAPATETAEMLSLLSFANSILQNFPEYLPFQFYQICTWEQPAGSRT

SEQ ID NO: 871390 - protein, 852 aa, Homo sapiens
MVARRVWGASRVPPASARPPPAACSGDAAVRGPRSPGRCLRAAAAADEPGHAGSAPAVAEAAAEETRGGDMPGGARDPRGLAAATPAASAGARGSARYSRGDSRPRRRGPALPAEHLEDRLFHQFKRFGEISLRLSHTPELGRVAYVNFRHPQDAREARQHALARQLLLYDRPLKVEPVYLRGGGGSSRRSSSSSAAASTPPPGPPAPADPLGYLPLHGGYQYKQRSLSPVAAPPLREPRARHAAAAFALDAAAAAAVGLSRERALDYYGLYDDRGRPYGYPAVCEEDLMPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 871391 - protein, 852 aa, Homo sapiens; identical to SEQ ID NO: 871390

SEQ ID NO: 871392 - protein, 852 aa, Homo sapiens; identical to SEQ ID NO: 871390

SEQ ID NO: 871393 - protein, 779 aa, Homo sapiens
MVEAGCESAEAGAEPACPGSSAAAPEYKTLLISSLSPALPAEHLEDRLFHQFKRFGEISLRLSHTPELGRVAYVNFRHPQDAREARQHALARQLLLYDRPLKVEPVYLRGGGGSSRRSSSSSAAASTPPPGPPAPADPLGYLPLHGGYQYKQRSLSPVAAPPLREPRARHAAAAFALDAAAAAAVGLSRERALDYYGLYDDRGRPYGYPAVCEEDLMPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 871394 - protein, 673 aa, Homo sapiens
GRSTKARYEAWVLSSSAAASTPPPGPPAPADPLGYLPLHGGYQYKQRSLSPVAAPPLREPRARHAAAAFALDAAAAAAVGLSRERALDYYGLYDDRGRPYGYPAVCEEDLMPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 871395 - protein, 470 aa, Homo sapiens
GAFGPERSNSRARAASEFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 871396 - protein, 154 aa, Homo sapiens [sequence omitted]

SEQ ID NO: 871397 - protein, 629 aa, Homo sapiens
MKRQSERDSSPSGRGSSSSAKRPREREREAEAGGRRAAHKASGGAKHPVPARARDKPRGSGSGGGGHRDGRGTGDANHRASSGRSSGSGAGGGGRGGKASGDPGASGMSPRASPLPPPPPPPGAEPACPGSSAAAPEYKTLLISSLSPALPAEHLEDRLFHQFKRFGEISLRLSHTPELGRVAYVNFRHPQDAREARQHALARQLLLYDRPLKVEPVYLRGGGGSSRRSSSSSAAASTPPPGPPAPADPLGYLPLHGGYQYKQRSLSPVAAPPLREPRARHAAAAFALDAAAAAAVGLSRERALDYYGLYDDRGRPYGYPAVCEEDLMPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSQQEGHTEACGSLTSMHLVQQCPGDPDSAQSV

SEQ ID NO: 871398 - protein, 852 aa, Homo sapiens; identical to SEQ ID NO: 871390

SEQ ID NO: 871399 - protein, 890 aa, Homo sapiens
MKRQSERDSSPSGRGSSSSAKRPREREREAEAGGRRAAHKASGGAKHPVPARARDKPRGSGSGGGGHRDGRGTGDANHRASSGRSSGSGAGGGGRGGKASGDPGASGMSPRASPLPPPPPPPGAEPACPGSSAAAPEYKTLLISSLSPALPAEHLEDRLFHQFKRFGEISLRLSHTPELGRVAYVNFRHPQDAREARQHALARQLLLYDRPLKVEPVYLRGGGGSSRRSSSSSAAASTPPPGPPAPADPLGYLPLHGGYQYKQRSLSPVAAPPLREPRARHAAAAFALDAAAAAAVGLSRERALDYYGLYDDRGRPYGYPAVCEEDLMPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 871400 - protein, 890 aa, Homo sapiens; identical to SEQ ID NO: 871399

SEQ ID NO: 871401 - protein, 673 aa, Homo sapiens
GRKKIGRTGAGCYSSSAAASTPPPGPPAPADPLGYLPLHGGYQYKQRSLSPVAAPPLREPRARHAAAAFALDAAAAAAVGLSRERALDYYGLYDDRGRPYGYPAVCEEDLMPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 871402 - protein, 523 aa, Homo sapiens
MLKAGLGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 871403 - protein, 1686 aa, Homo sapiens
YIRGFLLPPTMGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 871404 - protein, 1636 aa, Homo sapiens
YIRGFLLPPTMGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPWKRAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRFILLSCICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNLDLLRKIHSFNQYYYRGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 871405 - protein, 1618 aa, Homo sapiens
YIRGFLLPPTMGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPWKRAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRFILLSCICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNLDLLRKIHSFNQYYYRGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYNIIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 871406 - protein, 1635 aa, Homo sapiens
YIRGFLLPPTMGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPWKRAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRFILLSCICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKSNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 871407 - protein, 1408 aa, Homo sapiens
YIRGFLLPPTMGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPWKRAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRFILLSCICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNLDLLRKIHSFNQYYYRGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKAMDMLFCN

SEQ ID NO: 871408 - protein, 430 aa, Homo sapiens
MVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 871409 - protein, 1562 aa, Homo sapiens
YIRGFLLPPTMGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPWKRAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRFILLSCICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNLDLLRKIHSFNQYYYRGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGENSFVHSFLHSATI

SEQ ID NO: 871410 - protein, 645 aa, Homo sapiens
YIRGFLLPPTMGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERGQVVASTMPMCST

SEQ ID NO: 871411 - protein, 121 aa, Homo sapiens
LSLSCTPFFFSLSCTILSLNVPLTLLFNPRPSHPSAGWFSLPGPKASPLAHSSPPGLPIASRVRMNVAASALIFSIYCSEACSYRKLPNYQQIKASVLPPSNIPQTYYQYIFIFNNFFIKL

SEQ ID NO: 871412 - protein, 645 aa, Homo sapiens; identical to SEQ ID NO: 871410

SEQ ID NO: 871413 - protein, 1619 aa, Homo sapiens
YIRGFLLPPTMGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPWKRAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRFILLSCICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKSNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 871414 - protein, 253 aa, Homo sapiens
MDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 871415 - protein, 899 aa, Homo sapiens
YIRGFLLPPTMGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQSLALSPRLECNGKISGQLQVRLPGSSDSPASASQVAGITGTHHHAQPT

SEQ ID NO: 871416 - protein, 120 aa, Homo sapiens
VAFWLNLPKCLNERQGTCIPNYRTLPSFSNEIRMFYLIIPNSSNSYTSFEKFNAGHRAYACCPTPKEAYHSQGLIKCSLSRNGGLLSTVFFFLCFLGMLSIMSYRNADYSYSVWKGGSAS

SEQ ID NO: 871417 - protein, 782 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 871418 - protein, 917 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNSVRDSMTGLSQGHCHFLRTSRNKGIWEGPDVYAVFSVKHREEKRNQEMWPRLETHPLATVFPLAVELGSGPLPTLTSKSQPSYVKSWPAAHGTDLAKGCGESHEACISRPSNGMSSGISRRYLLVSETPSSSPACRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 871419 - protein, 537 aa, Homo sapiens [sequence omitted]

SEQ ID NO: 871420 - protein, 537 aa, Homo sapiens [sequence omitted]

SEQ ID NO: 871421 - protein, 782 aa, Homo sapiens; identical to SEQ ID NO: 871417

SEQ ID NO: 871422 - protein, 668 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGHTGNGLLNQAAEILGRSRL

SEQ ID NO: 871423 - protein, 581 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALCMPSTDPYITGSL

SEQ ID NO: 871424 - protein, 358 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMMLRQGTSFKTGAWHPCWKGIFSITFSFHLFDLPSSVGQIVLRKMHQGLGCAFIGHLGFYKGGGDNIFSNFLGSGVISVYKKC

SEQ ID NO: 871425 - protein, 174 aa, Homo sapiens [sequence omitted]

SEQ ID NO: 871426 - protein, 44 aa, Homo sapiens
MEEEDLAFSTKEEQQQLLQKVLAATDLDAEEEVVAGEFGSRSSQ

SEQ ID NO: 871427 - protein, 845 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAVMWTPGPPLGGGRHLGFQFSQVSLTQHLQPSSPAGSTLYNFTHCLITAELNVAVHVQHLPLSQISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 871428 - protein, 630 aa, Homo sapiens
MQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 871429 - protein, 782 aa, Homo sapiens; identical to SEQ ID NO: 871417

SEQ ID NO: 871430 - protein, 776 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQAFGAFGTHEFLMFWGPDRTLGFHWRLPPHIAGAKGAS

SEQ ID NO: 871431 - protein, 779 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKGDTSFDLPEANVLIQISSHGGSRRQEAQRLGRVLRAKKGMVAEEYNAFFYSLVSQDTQEMAYSTKRQRFLVDQGYSFKPVLVHVIRTRGWRGNGVSTRGPASSRRMTVPERGGTGQHDWLPNMSAVDHWGSNRLGTIRYSSEDNVHGNDIRQEPLYTRPQRYTYARSHKANAFTQPADHTSAHDADAGATAAEDHPYDDHRH

SEQ ID NO: 871432 - protein, 277 aa, Homo sapiens
PHLRLVEARVNGTGPKQFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMMLRQGTSFKTGAWHPCWKGIFSITFSFHLFDLPSSVGQIVLRKMHQGLGCAFIGHLGFYKGGGDNIFSNFLGSGVISVYKKC

SEQ ID NO: 871433 - protein, 131 aa, Homo sapiens
MGKRDRADRDKKKSRKRHYEDEEDDEEDAPGNDPQEAVPSAAGNQGLQAANAAEGRPHLQAPLGAVSVGLQTSDITEYLRKLSKTGVPDGIMQFIKLEKTCCCLPLSPFMTLGKSRNVFVLNNSLFKNMIV

SEQ ID NO: 871434 - protein, 77 aa, Homo sapiens
YEDEEDDEEDAPGNDPQEAVPSAAGKQVDESGTKVDEYGAKDYRLQMPLKDDHTSRPLWVVSMPLAWAGPRSVRSGS

SEQ ID NO: 871435 - protein, 83 aa, Homo sapiens
MILKHHFNPVFPLLTKTNSGIKGTLHLGLKCLSLLPVLSPPFRSDRTTQSPTLVRLILLLPFFSRNPSLDLRNSTSHLKVTVH

SEQ ID NO: 871436 - protein, 278 aa, Homo sapiens [sequence omitted]

SEQ ID NO: 871437 - protein, 157 aa, Homo sapiens
ICSPLLYSVIISNKACFSLILGVYIIGLVCASVHTGCMFRVQFCKFDLINHYFCDLLPLLKLSCSSIYVNKLLILCVGAFNILVPSLTILCSYIFIIASILHIRSTEGRSKAFSTCSSHMLAVVIFFGSAAFMYLQPSSISSMDQGKVSSVFYTIIV

SEQ ID NO: 871438 - protein, 110 aa, Homo sapiens
AQSIISSWVSEEAYYGRFVQQRYLSYRRVPHTNPPEYEFSWGPRSNLEISKMEVLGFVAKLHKKEPQHWPVQYREALADEADRARAKARAEASMRARPVLGPASTSGEGW

SEQ ID NO: 871439 - protein, 69 aa, Homo sapiens
ARGQGCSLQGMTAKLKLWLQGRQPEEGPEAGHGQGASKPSCVDENWVCFCSTQCSGGRPDHRLHACSWV

SEQ ID NO: 871440 - protein, 171 aa, Homo sapiens
RESWLRRAPCALHMGRLTEAAAAGSGSRAAGWAGSPPTLLPLSPTSPRCAATMASSDEDGTNGGASEAGEDREAPGKRRRLGFLATAWLTFYDIAMTAGRRLILSPRLECIGAISAHCQPQPPEFKRFSCLGLRSSWDYKRGPPRPINFCIFGRDRVSPCWPGWSRTPDLK

SEQ ID NO: 871441 - protein, 301 aa, Homo sapiens
RESWLRRAPCALHMGRLTEAAAAGSGSRAAGWAGSPPTLLPLSPTSPRCAATMASSDEDGTNGGASEAGEDREAPGKRRRLGFLATAWLTFYDIAMTAGWLVLAIAMVRFYMEKGTHRGLYKSIQKTLKFFQTFALLEIVHCLIGIVPTSVIVTGVQVSSRIFMVWLITHSIKPIQNEESVVLFLVAWTVTEITRYSFYTFSLLDHLPYFIKWARYNFFIILYPVGVAGELLTIYAALPHVKKTGMFSIRLPNKYNVSFDYYYFLLITMASYIPLFPQLYFHMLRQRRKVLHGEVIVEKDD

SEQ ID NO: 871442 - protein, 138 aa, Homo sapiens
MVWLITHSIKPIQNEESVVLFLVAWTVTEITRYSFYTFSLLDHLPYFIKWARYNFFIILYPVGVAGELLTIYAALPHVKKTGMFSIRLPNKYNVSFDYYYFLLITMASYIPLFPQLYFHMLRQRRKVLHGEVIVEKDD

SEQ ID NO: 871443 - protein, 178 aa, Homo sapiens
YTQPSQHPGPSILLLHMGRLTEAAAAGSGSRAAGWAGSPPTLLPLSPTSPRCAATMASSDEDGTNGGASEAGEDREAPGKRRRLGFLATAWLTFYDIAMTAGWLVLAIAMVRFYMEKGTHRGLYKSIQKTLKFFQTFALLEIVHCLIGIVPTSVIVTGVQVSSRIFMVWLITHSIKPI

SEQ ID NO: 871444 - protein, 304 aa, Homo sapiens
YTQPSQHPGPSILLLHMGRLTEAAAAGSGSRAAGWAGSPPTLLPLSPTSPRCAATMASSDEDGTNGGASEAGEDREAPGKRRRLGFLATAWLTFYDIAMTAGWLVLAIAMVRFYMEKGTHRGLYKSIQKTLKFFQTFALLEIVHCLIGIVPTSVIVTGVQVSSRIFMVWLITHSIKPIQNEESVVLFLVAWTVTEITRYSFYTFSLLDHLPYFIKWARYNFFIILYPVGVAGELLTIYAALPHVKKTGMFSIRLPNKYNVSFDYYYFLLITMASYIPLFPQLYFHMLRQRRKVLHGEVIVEKDD

SEQ ID NO: 871445 - protein, 301 aa, Homo sapiens; identical to SEQ ID NO: 871441

SEQ ID NO: 871446 - protein, 301 aa, Homo sapiens; identical to SEQ ID NO: 871441

SEQ ID NO: 871447 - protein, 224 aa, Homo sapiens
YTQPSQHPGPSILLLHMGRLTEAAAAGSGSRAAGWAGSPPTLLPLSPTSPRCAATMASSDEDGTNGGASEAGEDREAPGKRRRLGFLATAWLTFYDIAMTAGWLVLAIAMVRFYMEKGTHRGLYKSIQKTLKFFQTFALLEIVHCLIGIVPTSVIVTGVQVSSRIFMVWLITHSIKPIQNEESVVLFLVAWTVTEITRYSFYTFSLLDHLPYFIKWARWRYLAV

SEQ ID NO: 871448 - protein, 152 aa, Homo sapiens
EPLSRPGILRSLHFQGQPQRVRSEEFLSTKSAHFSDNTEFPFLCLREKGKETLPGSFPVFPWSNARIYFCHNAKLKKKKIQRSDTLGGCYVTDFSKFCCGEREGGELKTAHNRNEMYISAVDLKSTAWLVGRKIISLENSNSALTFFFYNFR

SEQ ID NO: 871449 - protein, 79 aa, Homo sapiens
SDLHEVVSLKERMARYQAAVSRGDCRSFSANMMEESEMCAVPGGLAKVKKQFEDEITSSRNTFAQYQYQHQNRSEQEAI

SEQ ID NO: 871450 - protein, 958 aa, Homo sapiens
MHTCCPPVTLEQDLHRKMHSWMLQTLAFAVTSLVLSCAETIDYYGEICDNACPCEEKDGILTVSCENRGIISLSEISPPRFPIYHLLLSGNLLNRLYPNEFVNYTGASILHLGSNVIQDIETGAFHGLRGLRRLHLNNNKLELLRDDTFLGLENLEYLQVDYNYISVIEPNAFGKLHLLQVLILNDNLLSSLPNNLFRFVPLTHLDLRGNRLKLLPYVGLLQHMDKVVELQLEENPWNCSCELISLKDWLDSISYSALVGDVVCETPFRLHGRDLDEVSKQELCPRRLISDYEMRPQTPLSTTGYLHTTPASVNSVATSSSAVYKPPLKPPKGTRQPNKPRVRPTSRQPSKDLGYSNYGPSIAYQTKSPVPLECPTACSCNLQISDLGLNVNCQERKIESIAELQPKPYNPKKMYLTENYIAVVRRTDFLEATGLDLLHLGNNRISMIQDRAFGDLTNLRRLYLNGNRIERLSPELFYGLQSLQYLFLQYNLIREIQSGTFDPVPNLQLLFLNNNLLQAMPSGVFSGLTLLRLNLRSNHFTSLPVSGVLDQLKSLIQIDLHDNPWDCTCDIVGMKLWVEQLKVGVLVDEVICKAPKKFAETDMRSIKSELLCPDYSDVVVSTPTPSSIQVPARTSAVTPAVRLNSTGAPASLGAGGGASSVPLSVLILSLLLVFIMSVFVAAGLFVLVMKRRKKNQSDHTSTNNSDVSSFNMQYSVYGGGGGTGGHPHAHVHHRGPALPKVKTPAGHVYEYIPHPLGHMCKNPIYRSREGNSVEDYKDLHELKVTYSSNHHLQQQQQPPPPPQQPQQQPPPQLQLQPGEEERRESHHLRSPAYSVSTIEPREDLLSPVQDADRFYRGILEPDKHCSTTPAGNSLPEYPKFPCSPAAYTFSPNYDLRRPHQYLHPGAGDSRLREPVLYSPPSAVFVEPNRNEYLELKAKLNVEPDYLEVLEKQTTFSQF

SEQ ID NO: 871451 - protein, 639 aa, Homo sapiens
ARLSKGSDRKWSWGDKNVDNNKRISTGKKMSQTSLKQKKNEPGMRSSKESLEAEKRKESDKTGVRLSNQMRRAVNPNHSLRCCPFQGHSSCRRCLCAAEGTALGPCHTIRIYIHMCLLWEQGQQITMMRGSQESSLRKTDSRGYLVRSQWSRISRSPSTKAPSIDEPRSRNTSAKLPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 871452 - protein, 579 aa, Homo sapiens
ARLSKGSDRKWSWGDKNVDNNKRISTGKKMSQTSLKQKKNEPGMRSSKESLEAEKRKESDKTGVRLSNQGSQESSLRKTDSRGYLVRSQWSRISRSPSTKAPSIDEPRSRNTSAKLPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 871453 - protein, 579 aa, Homo sapiens; identical to SEQ ID NO: 871452

SEQ ID NO: 871454 - protein, 135 aa, Homo sapiens
RASRRHKKSLNFKKRKEGTTPGCRSDRPPGSLAMRECSLQVTVSPPAAPVGELGRSLAAPNGFVTGLFVADAPAGRRRSQVIRQSSVQAEHPEPPARGSLHHLPLLWCSVSAQNRFGVEFKLKSLLGQRKFAPDG

SEQ ID NO: 871455 - protein, 105 aa, Homo sapiens
MAPAGMSGAQDNSCLYQEIAPSFQRLPCPRTSSRHFSEAMTCPCGWRPFKGGPGGLKGPVWPAKEENSCSHGRIQRVQRRRVPSASPLIQKINRRSVLFHPYCWS

SEQ ID NO: 871456 - protein, 33 aa, Homo sapiens
MVPAQTLGQAPALSSRRSQAGTRELLEDRESGR

SEQ ID NO: 871457 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 871458 - protein, 222 aa, Homo sapiens
PGAPPLPPGAQTRPRPRGVGETTLAMWPGLAGLSRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 871459 - protein, 277 aa, Homo sapiens; identical to SEQ ID NO: 871457

SEQ ID NO: 871460 - protein, 237 aa, Homo sapiens
QAGTRRNGLMMRGSGLTLPSLPSARFSAGPPTQRSRPTMSNMEKHLFNLKFAAKELSRSAKKCDKEEKAEKAKIKKAIQKGNMEVARIHAENAIRQKNQAVNFLRMSARVDAVAARVQTAVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLARLRDQV

SEQ ID NO: 871461 - protein, 199 aa, Homo sapiens
MSNMEKHLFNLKFAAKELSRSAKKCDKEEKAEKAKIKKAIQKGNMEVARIHAENAIRQKNQAVNFLRMSARVDAVAARVQTAVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLARLRDQV

SEQ ID NO: 871462 - protein, 203 aa, Homo sapiens
GRVGRPTRRKHLFNLKFAAKELSRSAKKCDKEEKAEKAKIKKAIQKGNMEVARIHAENAIRQKNQAVNFLRMSARVDAVAARVQTAVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLARLRDQV

SEQ ID NO: 871463 - protein, 199 aa, Homo sapiens; identical to SEQ ID NO: 871461

SEQ ID NO: 871464 - protein, 218 aa, Homo sapiens
MSNMEKHLFNLKFAAKELSRSAKKCDKEEKAEKAKIKKAIQKGNMEVARIHAENAIRQKNQAVNFLRMSARVDAVAARVQTAVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLAPAFSGNQVVYPGRKPPLPGGVFSLG

SEQ ID NO: 871465 - protein, 199 aa, Homo sapiens; identical to SEQ ID NO: 871461

SEQ ID NO: 871466 - protein, 199 aa, Homo sapiens; identical to SEQ ID NO: 871461

SEQ ID NO: 871467 - protein, 199 aa, Homo sapiens; identical to SEQ ID NO: 871461

SEQ ID NO: 871468 - protein, 219 aa, Homo sapiens
QAGTRRNGLMMRGSGLTLPSLPSARFSAGPPTQRSRPTMSNMEKHLFNLKFAAKELSRSAKKCDKEEKAEKAKIKKAIQKGNMEVARIHAGVDAVAARVQTAVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLARLRDQV

SEQ ID NO: 871469 - protein, 363 aa, Homo sapiens
MAAAAMAAAAGGGAGAARSLSRFRGCLAGALLGDCVGSFYEAHDTVDLTSVLRHVQSLEPDPGTPGSERTEALYYTDDTAMARALVQSLLAKEAFDEVDMAHRFAQEYKKDPDRGYGAGVVTVFKKLLNPKCRDVFEPARAQFNGKGSYGNGGAMRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 871470 - protein, 283 aa, Homo sapiens
MARALVQSLLAKEAFDEVDMAHRFAQEYKKDPDRGYGAGVVTVFKKLLNPKCRDVFEPARAQFNGKGSYGNGGAMRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 871471 - protein, 209 aa, Homo sapiens
MRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 871472 - protein, 363 aa, Homo sapiens; identical to SEQ ID NO: 871469

SEQ ID NO: 871473 - protein, 113 aa, Homo sapiens [sequence omitted]

SEQ ID NO: 871474 - protein, 218 aa, Homo sapiens
GRTGAMAPAQAPLLPLLLLLLPLPPPPFAPPEDRRRANSDRYAVYWNRSNPRFHAGAGDDGGGYTVEVSINDYLDIYCPHYGAPLPPAERMEHYVLYMVNGEGHASCDHRQRGFKRWECNRPAAPGGPLKFSEKFQLFTPFSLGFEFRPGHEYYYISATPPNAVDRPCLRLKVYVRPTNETLYEAPEPIFTSNNSCSSPGGCRLFLSTIPVLWTLLGS

SEQ ID NO: 871475 - protein, 107 aa, Homo sapiens [sequence omitted]

SEQ ID NO: 871476 - protein, 126 aa, Homo sapiens
MGLQSSSGDLLFSAPPQPHLAVGQLLLNQHPQDSATQPCHTCFLRASSEAGAHPHARRLFCFFDALTCPFQRIAYVLCWLKKKIAGNQPQPFLSISSLELQRLQLTIPLRQEFLLWHCDILGLVVL

SEQ ID NO: 871477 - protein, 115 aa, Homo sapiens
RLKHAFLPLGQHEASNSTGRHGVPWVDEAAWQPGLETWPPGQLWRAPQQSWSPAPQHGWPCGLRTLLITQCLVLGQPQRSVYKYSLTRWRAGRPSPLPRRSPLPVSFPSLPLTPF

SEQ ID NO: 871478 - protein, 530 aa, Homo sapiens
FLESSLRILYRLFESVLPPLPAALQSRMNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGQERPSVTSYKEVLRQCPLALDAILGLLSLSVKGAEVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGLIECYLASNSIREAMVMANNVYKTLGANAQTLTLLATVCLEDPVTQEKAKTLFDKALTQRPDYIKAVVKKAELLSREQKYEDGIALLRNALANQSDCVLHRILGDFLVAVNEYQEAMDQYSIALR

SEQ ID NO: 871479 - protein, 131 aa, Homo sapiens
PLQEFGTQQSTQASRTRARKKPPEGTISLCVNMTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 871480 - protein, 119 aa, Homo sapiens
AGTSSCRIRHAEGTISLCVNMTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 871481 - protein, 183 aa, Homo sapiens
IDLRMPWIGEPSGGPGIRPMAGTNFQRQQSTQASRTRARKKPPEGTISLCVNMTSKLAVALLAAFLISAALCEGAVLPRSAKELRCQCIKTYSKPFHPKFIKELRVIESGPHCANTEIIVKLSDGRELCLDPKENWVQRVVEKFLKSETSSKSTSTLHVLCGSVVGLPDAIQDSWLNLNFSKQ

SEQ ID NO: 871482 - protein, 110 aa, Homo sapiens
IDLRMPWIGEPSGGPGIRPMAGTNFQRQQSTQASRTRARKKPPEGTISLCVNMTSKLAVALLAAFLISAALCEGAVLPRSAKELRCQCIKTYSKPFHPRKTGCRGLWRSF

SEQ ID NO: 871483 - protein, 154 aa, Homo sapiens
IDLRMPWIGEPSGGPGIRPMAGTNFQRQQSTQASRTRARKKPPEGTISLCVNMTSKLAVALLAAFLISAALCEGAVLPRSAKELRCQCIKTYSKPFHPKFIKELRVIESGPHCANTEIINPSLLARIHKSLFHCALVSPLFLSGKSISHHLTSQ

SEQ ID NO: 871484 - protein, 110 aa, Homo sapiens
IDLRMPWIGEPSGGPGIRPMAGTNFQRQQSTQASRTRARKKPPEGTISLCVNMTSKLAVALLAAFLISAALCEGAVLPRSAKELRCQCIKTYSKPFQSPCSTVPWFLLYF

SEQ ID NO: 871485 - protein, 174 aa, Homo sapiens
IDLRMPWIGEPSGGPGIRPMAGTNFQRQQSTQASRTRARKKPPEGTISLCVNMTSKLAVALLAAFLISAALCEGAVLPRSAKELRCQCIKTYSKPFHPKFIKELRVIESGPHCANTEIIVKLSDGRELCLDPKENWVQRVVEKFLKRQRSLKTGGWIHKLSSNPREAQQTSDHG

SEQ ID NO: 871486 - protein, 156 aa, Homo sapiens
IDLRMPWIGEPSGGPGIRPMAGTNFQRQQSTQASRTRARKKPPEGTISLCVNMTSKLAVALLAAFLISAALCEGAVLPRSAKELRCQCIKTYSKPFHPKFIKELRVIESGPHCANTEIIFLYRFLDGRELCLEPQGQIGGCRRVVEESTRTQGLTG

SEQ ID NO: 871487 - protein, 92 aa, Homo sapiens
IDLRMPWIGEPSGGPGIRPMAGTNFQRQQSTQASRTRARKKPPEGTISLCVNMTSKLAVALLAAFLISAALCEGKHIFLTYSVFLCLNVILR

SEQ ID NO: 871488 - protein, 151 aa, Homo sapiens
IDLRMPWIGEPSGGPGIRPMAGTNFQRQQSTQASRTRARKKPPEGTISLCVNMTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 871489 - protein, 132 aa, Homo sapiens
IDLRMPWIGEPSGGPGIRPMAGTNFQRQQSTQASRTRARKKPPEGTISLCVNMTSKLAVALLAAFLISAALCEGAVLPRSAKELRCQCIKTYSKPFHNPSLLARIHKSLFHCALVSPLFLSGKSISHHLTSQ

SEQ ID NO: 871490 - protein, 74 aa, Homo sapiens
IDLRMPWIGEPSGGPGIRPMAGTNFQRQQSTQASRTRARKKPPEGTISLCVNMTSKLAVALLAAFLISAALCEV

SEQ ID NO: 871491 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 871492 - protein, 254 aa, Homo sapiens
MAAGRGQSDEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871493 - protein, 197 aa, Homo sapiens
LAASLGMCWGPPFHGFCRLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKNGEEREAAKTTISGEEREAAKNEKLVKKREAG

SEQ ID NO: 871494 - protein, 941 aa, Homo sapiens
GGGGAPRPTRASWSGKKGGASGCARSGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871495 - protein, 246 aa, Homo sapiens
MVRGLGVTEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVLSPRSLCV

SEQ ID NO: 871496 - protein, 169 aa, Homo sapiens
SLKTISIQFRKPRGKPVCGNVAVEYLKDSNLLFFGGLLVAIAVEHWNLHKRIALRVLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871497 - protein, 927 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871498 - protein, 927 aa, Homo sapiens; identical to SEQ ID NO: 871497

SEQ ID NO: 871499 - protein, 927 aa, Homo sapiens; identical to SEQ ID NO: 871497

SEQ ID NO: 871500 - protein, 927 aa, Homo sapiens; identical to SEQ ID NO: 871497

SEQ ID NO: 871501 - protein, 927 aa, Homo sapiens; identical to SEQ ID NO: 871497

SEQ ID NO: 871502 - protein, 987 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQVKNRTPPQSVPGKYLWCWKEEHGVLAQEERCDQVGDFCLAGLGDVSSVVLLTSTSLCFFQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871503 - protein, 992 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGLCLYESVLCFPSDSSLLSWSLFSGCFSFLLHSDLLLDSLDFSCFPKLFLGNFSFLSILPHHPDAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871504 - protein, 1005 aa, Homo sapiens
GGDPNMQVEAGFGPAVAAEMEEGGRDKAPVQPQQSPAAAPGGTDEKPSGKERRDAGDKDKEQELVRRDPESRQKEAAGLSHGGSAGLRPDTQLPHRARERAVGATLGTPGTLPLCSSFSVPRCHLRRPHQPSPPPREVDSEQSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871505 - protein, 1076 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGLCLYESVLCFPSDSSLLSWSLFSGCFSFLLHSDLLLDSLDFSCFPKLFLGNFSFLSILPHHPDAGSGNVLKVQQLLHICSEHFDSKEKEEDKDKKEKKDKDKKEAPADMGAHQVYGQLGTCREAVRRDKHIGEAGFGFCFRASLGIAMFEIACDWVLYVRGKGVPHRMAFYFQMGLESRVTVFYSLSLMGSALSSIQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871506 - protein, 1031 aa, Homo sapiens
GGDPNMQVEAGFGPAVAAEMEEGGRDKAPVQPQQSPAAAPGGTDEKPSGKERRDAGDKDKEQELVRRDPESRQKEAAGLSHGGSAGLRPDTQLPHRARERAVGATLGTPGTLPLCSSFSVPRCHLRRPHQPSPPPREVDSEQSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVSTLDSLTHREVLPLKLCSLNLSGTICRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871507 - protein, 701 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLVSIA

SEQ ID NO: 871508 - protein, 684 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQVIWAAGHLQRGCEKR

SEQ ID NO: 871509 - protein, 537 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVSRGY

SEQ ID NO: 871510 - protein, 256 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVLSPRSLCV

SEQ ID NO: 871511 - protein, 102 aa, Homo sapiens
MLVERLGEKDTSLYRPALEELRRQIRSSTTSMTSVPKPLKFLRPHYGKLKEIYENMAPGENKGNMCEMLKEVDSAGLLFGFSLIFGCGWEEGGGIEEFGVTS

SEQ ID NO: 871512 - protein, 161 aa, Homo sapiens
DAWVDPRVANNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871513 - protein, 307 aa, Homo sapiens
GGGGAPRPTRASWSGKKGGASGCARSGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSYVPELRIKLWVCLGVSKLPFLTWMLVYADCNLLLKLDVI

SEQ ID NO: 871514 - protein, 88 aa, Homo sapiens
LAERLGEKDTSLYRPALEELRRQIRSSTTSMTSVPKPLKFLRPHYGKLKEIYENMAPGENKRFAADIISVLAMTMSGEHHQYSEHHQY

SEQ ID NO: 871515 - protein, 108 aa, Homo sapiens
RARYPENMAPGENKRFAADIISVLAMTMSGERECLKYRLVGSQEELASWGHEYVRHLAGEVAKEWQELDDAEDLRGLGTEVMEVVEERICLRNSSSAGRYRDVSSWGR

SEQ ID NO: 871516 - protein, 929 aa, Homo sapiens
GRVGRPTRRKKPLHGALGTGPDTFREGHPYPLPLQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871517 - protein, 927 aa, Homo sapiens; identical to SEQ ID NO: 871497

SEQ ID NO: 871518 - protein, 927 aa, Homo sapiens; identical to SEQ ID NO: 871497

SEQ ID NO: 871519 - protein, 927 aa, Homo sapiens; identical to SEQ ID NO: 871497

SEQ ID NO: 871520 - protein, 927 aa, Homo sapiens; identical to SEQ ID NO: 871497

SEQ ID NO: 871521 - protein, 956 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGEYPAEEGHKQIGGRFEAPFFTSVMLNIPGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871522 - protein, 986 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGIILFLLCLLFCFDHFFCPLGVIKLSDKGSTMQFFGELFIITGSSGEGHFKTNRFFPGIGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871523 - protein, 870 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQVRG

SEQ ID NO: 871524 - protein, 808 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 871525 - protein, 801 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQVKNRTPPQSVPGKYLW

SEQ ID NO: 871526 - protein, 738 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQEWCSGGCLMLWGADNWCRWLTNFWHLLRLGAYTPGVVFNGSFCLIPSSWYLAFSVCPNPPPFPGGGGAN

SEQ ID NO: 871527 - protein, 665 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKNSRGMTEVQNAGPGI

SEQ ID NO: 871528 - protein, 553 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAVSSFSLWNDTAPRFAEDPD

SEQ ID NO: 871529 - protein, 476 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKVGLHTACSWGLPRSIF

SEQ ID NO: 871530 - protein, 293 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSYVPELRIKLWVCLGVSKLPFLTWMLVYADCNLLLKLDVI

SEQ ID NO: 871531 - protein, 478 aa, Homo sapiens
GGDPNMQVEAGFGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAVSSFSLWNDTAPRFAEDPD

SEQ ID NO: 871532 - protein, 859 aa, Homo sapiens
AECPPAPPGSQAPRRPAGRIPPSVMAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSSHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPHQKQAAGMSQETFEEKYRLSPTLSSTKGHLLIHSRPRSSSVKRKRVSHGSHSPPKEKCKRKRSTRRSIMPRLQLCRSEGRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSVKNRPTRHDVLDDSCDGFKDLIKPHEELKKSGRGKKPTRTLVMTSMPSEKQNVVIQVVDKLKGFSIAPDVCETTTHVLSGKPLRTLNVLLGIARGCWVLSYDWVLWSLELGHWISEEPFELSHHFPAAPLCRSECHLSAGPYRGTLFADQPAMFVSPASSPPVAKLCELVHLCGGRVSQVPRQASIVIGPYSGKKKATVKYLSEKWVLDSITQHKVCAPENYLLSQ

SEQ ID NO: 871533 - protein, 799 aa, Homo sapiens
AECPPAPPGSQAPRRPAGRIPPSVMAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSSHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPHQKQAAGMSQETFEEKYRLSPTLSSTKGHLLIHSRPRSSSVKRKRVSHGSHSPPKEKCKRKRSTRRSIMPRLQLCRSEGRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSVKNRPTRHDVLDDSCDGFKDLIKPHEELKKSGRGKKPTRTLVMTSMPSEKQNVVIQVVDKLKGFSIAPDVCETTTHVLSGKPLRTLNVLLGIARGCWVLSYDWVLWSLELGHWISEEPFELSHHFPAAPVSQMLFYDGKCSLLFSRNYYKHKGGLKFLSSQAQLCP

SEQ ID NO: 871534 - protein, 850 aa, Homo sapiens
AECPPAPPGSQAPRRPAGRIPPSVMAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSSHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPHQKQAAGMSQETFEEKYRLSPTLSSTKGHLLIHSRPRSSSVKRKRVSHGSHSPPKEKCKRKRSTRRSIMPRLQLCRSEGRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSVKNRPTRHDVLDDSCDGFKDLIKPHEELKKSGRGKKPTRTLVMTSMPSEKQNVVIQVVDKLKGFSIAPDVCETTTHVLSGKPLRTLNVLLGIARGCWVLSYDWVLWSLELGHWISEEPFELSHHFPAAPLCRSECHLSAGPYRGTLFADQPAMFVSPASSPPVAKLCELVHLCGGRVSQVPRQASIVIGPYSGKKKATVKYLSEKWVLDWQASHPAH

SEQ ID NO: 871535 - protein, 815 aa, Homo sapiens
AECPPAPPGSQAPRRPAGRIPPSVMAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSSHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPHQKQAAGMSQETFEEKYRLSPTLSSTKGHLLIHSRPRSSSVKRKRVSHGSHSPPKEKCKRKRSTRRSIMPRLQLCRSEGRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSVKNRPTRHDVLDDSCDGFKDLIKPHEELKKSGRGKKPTRTLVMTSMPSEKQNVVIQVVDKLKGFSIAPDVCETTTHVLSGKPLRTLNVLLGIARGCWVLSYDWVLWSLELGHWISEEPFELSHHFPAAPLCRSECHLSAGPYRGTLFADQPAMFVSPASSPPVAKLCELVHLCGGCSEPRLQ

SEQ ID NO: 871536 - protein, 634 aa, Homo sapiens
AECPPAPPGSQAPRRPAGRIPPSVMAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSSHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPHQKQAAGMSQETFEEKYRLSPTLSSTKGHLLIHSRPRSSSVKRKRVSHGSHSPPKEKCKRKRSTRRSIMPRLQLCRSEGRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSM

SEQ ID NO: 871537 - protein, 859 aa, Homo sapiens; identical to SEQ ID NO: 871532

SEQ ID NO: 871538 - protein, 672 aa, Homo sapiens
AECPPAPPGSQAPRRPAGRIPPSVMAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSSHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPHQKQAAGMSQETFEEKYRLSPTLSSTKGHLLIHSRPRSSSVKRKRVSHGSHSPPKEKCKRKRSTRRSIMPRLQLCRSEGRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSVKNRPTRHDVLDDSCDGFKDLIKPHEELKKSGRGKKVSV

SEQ ID NO: 871539 - protein, 58 aa, Homo sapiens
ACRNLSHGGESEAELVMSSEKAKQEEKQRRLLTSGKQLRVRVRTGGHGGPGTKLVPGA

SEQ ID NO: 871540 - protein, 181 aa, Homo sapiens
GPHPQGLEPLCARSHSTAGPFLPWLCTTAQAVPPATCPSFPPPRVLRFPGSFLCQCPNLERMCHIAPLCSHVLGGRSASCPRSGARTKQHSWEMAFPLGAQNCRDHSLGSGDCWLTHSHTRCPQTLLAGGIVELCALNARSGPSTQAAGSHRVFRRLGSVSVPLAPPTPLCEGAPSHPWLL

SEQ ID NO: 871541 - protein, 121 aa, Homo sapiens
MPMFIVNTNVPRASVPDGFLSELTQQLAQATWQAPPSTSRCTWSRTSSMAFGRAPASRARCLQPAQHRQDRRRAEPLLTASLLMLACWPDARLRISSPDRVYINYYDMNAANVGWNNSTFA

SEQ ID NO: 871542 - protein, 121 aa, Homo sapiens
MPMFIVNTNVPRASVPDGFLSELTQQLAQATWQAPPSTSRCTWSRTSSMAFGRAPASRARCLQPAQHRQDRRRAEPLLTASLLMLACWPEARLRISSPDRVYINYYDMNAANVGWNNSTFA

SEQ ID NO: 871543 - protein, 155 aa, Homo sapiens
GRQLRLGRGWVLAQRRPRRVRHVPLRGSPGPSAIMPMFIVNTNVPRASVPDGFLSELTQQLAQATWQAPPSTSRCTWSRTSSMAFGRAPASRARCLQPAQHRQDRRRAEPLLTASLLMLACWPDARLRISSPDRVYINYYDMNAANVGWNNSTFA

SEQ ID NO: 871544 - protein, 161 aa, Homo sapiens
QFRLGAGWVLNRPRVRHVAQRRPRRVRHVPLRGSPGPSAIMPMFIVNTNVPRASVPDGFLSELTQQLAQATWQAPPSTSRCTWSRTSSMAFGRAPASRARCLQPAQHRQDRRRAEPLLTASLLMLACWPDARLRISSPDRVYINYYDMNAANVGWNNSTFA

SEQ ID NO: 871545 - protein, 161 aa, Homo sapiens; identical to SEQ ID NO: 871544

SEQ ID NO: 871546 - protein, 120 aa, Homo sapiens
ASRGWVVIGRGSGGAARASCASARVSWSFCHHADVHRKHQRAPRLRAGRVPLRAHPAAGAGHLASPPQYIAVHVVPDQLNGLRASSSEPCALLAACTASARSAARRTAPYSKLADAGLLA

SEQ ID NO: 871547 - protein, 293 aa, Homo sapiens
RTRPRLKLCGHGRRLRRSSAAAAARASCASARVSWSFCHHADVHRKHQRAPRLRAGRVPLRAHPAAGAGHLASPPQQYIAVHVVPDQLMAFGRAPASRARCLQPAQHRQDRRRAEPLLTASLLMLACWPDARLRISSPDQGLHQLLRHERGQCGLEQLHLRLRAAPSPKSRRDPRCLRWLHPGNPAARCVLGRPTQLRAWREDNYAGLGDLQTQPQPTTTPTLVAAARGPGKKVLYPPPVWAPAPHVSADTRPYGAHRKPGPARGGPPNKNARAPRGFGPPGGGAPGSTEPRR

SEQ ID NO: 871548 - protein, 117 aa, Homo sapiens
LRARYEAWVLHVAQRRPRRVRHVPLRGSPGPSAIMPMFIVNTNVPRASVPDGFLSELTQQLAQATWQAPPSSTSRCTWSRTSSWPSGELQRAVRAACSLHSIGKIGGAQNRSLQQAC

SEQ ID NO: 871549 - protein, 117 aa, Homo sapiens; identical to SEQ ID NO: 871548

SEQ ID NO: 871550 - protein, 88 aa, Homo sapiens
MEDELEPSLRPRTQIQGRILLLTICAAGIGGTFQFGYNLSIINAPTLVCILSGWRLSLSEWVLANSCPLRGFSQASTRWHFLPQVCLH

SEQ ID NO: 871551 - protein, 121 aa, Homo sapiens; identical to SEQ ID NO: 871541

SEQ ID NO: 871552 - protein, 121 aa, Homo sapiens; identical to SEQ ID NO: 871541

SEQ ID NO: 871553 - protein, 121 aa, Homo sapiens; identical to SEQ ID NO: 871541

SEQ ID NO: 871554 - protein, 121 aa, Homo sapiens; identical to SEQ ID NO: 871541

SEQ ID NO: 871555 - protein, 121 aa, Homo sapiens; identical to SEQ ID NO: 871541

SEQ ID NO: 871556 - protein, 237 aa, Homo sapiens
MEDELEPSLRPRTQIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLSTSRCTWSRTSSWLRASSSEPCALLAACTASARSAARRTAPYSKLADAGLLA

SEQ ID NO: 871557 - protein, 151 aa, Homo sapiens
MPMFIVNTNVPRASVPDGFLSELTQQLAQATWQAPPRFAGRGQEEGGAHRTRGSALGAGEATPERSWGAGRGEDGGSGPKWTFGARRGRWGGLTAPFPRSTSRCTWSRTSSWLRARSSEPCALLAACTASARSAARRTAPYSKLADAGLLA

SEQ ID NO: 871558 - protein, 496 aa, Homo sapiens
MRALRRLIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 871559 - protein, 115 aa, Homo sapiens
RNAARGRHECRWKALKGVLHVPLRGSPGPSAIMPMFIVNTNVPRASVPDGFLSELTQQLAQATWQAPPSSTSRCTWSRTSSWPSGELQRAVRAACSLHSIGKIGGAQNRSLQQAC

SEQ ID NO: 871560 - protein, 119 aa, Homo sapiens
MPMFIVNTNVPRASVPDGFLSELTQQLAQATWQAPPSTSRCTWSRTSSMAFGRAPASRARCLQPAQHRQDRRRAEPLLTASLLMLACWPDARLRISSPDRYAESRRGGGGAAARGQARD

SEQ ID NO: 871561 - protein, 548 aa, Homo sapiens
APLSPLGAARCPSLRAQAAGSPLANGSRGLPGTARPPLRPLFRMLHALLRSRMIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLAFRSSLPLGHSNLAHGLASFALHRSGFGHLLPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 871562 - protein, 436 aa, Homo sapiens
APLSPLGAARCPSLRAQAAGSPLANGSRGLPGTARPPLRPLFRMLHALLRSRMIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRVYAYASSVFRKAGVPEAKIQYAIIGTGSCELLTAVVSCVVIERVGRRVLLIGGYSLMTCWGSIFTVALCLAFRSSLPLGHSNLAHGLASFALHRSGFGHLLPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 871563 - protein, 218 aa, Homo sapiens
MPMFIVNTNVPRASVPDGFLSELTQQLAQATWQAPPSTSRCTWSRTSSMAFGRAPASRARCLQPAQHRQDRRRAEPLLTASLLMLACWPDARLRISSPDQGLHQLLRHERGQCGLEQLHLRLRAAGTHAVCAGSTRGDPARYALVVPKGPQTQPPKAFLGGGKKIKRGERRTKKTNETTPKGTGRKDKQHRRERYNTQAADEKTGTHKPRRDTKQAAG

SEQ ID NO: 871564 - protein, 179 aa, Homo sapiens
MPMFIVNTNVPRASVPDGFLSELTQQLAQATWQAPPSTSRCTWSRTSSMAFGRAPASRARCLQPAQHRQDRRRAEPLLTASLLMLACWPDARLRISSPDQGLHQLLRHERGQCGLEQLHLRLRAAGTHAVCAGSTREPAARCVLGPPTPTFWWGEINGLETTACAGFPARPPQPSGGDE

SEQ ID NO: 871565 - protein, 151 aa, Homo sapiens; identical to SEQ ID NO: 871557

SEQ ID NO: 871566 - protein, 117 aa, Homo sapiens
MPMFIVNTNVPRASVPDGFLSELTQQLAQATWQAPPSTSRCTWSRTSSMAFGGSSEPCALCSLHSIGKIGGAQNRSYSKLLCGLLAERLRISPDSRVYINYYDMNAANVGWNNSTFA

SEQ ID NO: 871567 - protein, 146 aa, Homo sapiens
MPMFIVNTNVPRASVPDGFLSELTQQLAQATWQAPPRFAGRGQEEGGAHRTRGSALGAGEATPERSWGAGRGEDGGSGPKWTFGARRGRWGGLTAPFPRSSTSRCTWSRTSSWPSGELQRAVRAACSLHSIGKIGGAQNRSLQQAC

SEQ ID NO: 871568 - protein, 146 aa, Homo sapiens; identical to SEQ ID NO: 871567

SEQ ID NO: 871569 - protein, 103 aa, Homo sapiens
MPMFIVNTNVFGRAPASRARCLQPAQHRQDRRRAEPLLTASLLMLACWPDARLRISSPDQGLHQLLRHERGQCGLEQLHLRLRAAGPTLSALAPPGNPPHAVF

SEQ ID NO: 871570 - protein, 109 aa, Homo sapiens
TLAKRHLAWPLLCLLRELLGGPQAWPLLLASCLVPGALQLASLPLLPESPRYLLIDCGDTEACLAGESLSLGSQTALDQGMHLPRVYGSPFHRFHLSRKSYPSLCASIS

SEQ ID NO: 871571 - protein, 97 aa, Homo sapiens
GGQMPPHDLSWAFCLGVDGDTPGLGVFFNPQEALSHFLYVPFLGVCVCGAIYTGLFLPETKGKTFQEISKELHRLNFPRRAQGPTWRSLEVIQSTEL

SEQ ID NO: 871572 - protein, 121 aa, Homo sapiens; identical to SEQ ID NO: 871542

SEQ ID NO: 871573 - protein, 155 aa, Homo sapiens; identical to SEQ ID NO: 871543

SEQ ID NO: 871574 - protein, 121 aa, Homo sapiens; identical to SEQ ID NO: 871542

SEQ ID NO: 871575 - protein, 121 aa, Homo sapiens; identical to SEQ ID NO: 871542

SEQ ID NO: 871576 - protein, 81 aa, Homo sapiens
ARSSAAAAARASVPLRGSPGPSAIMPMFIVNTNVPRASVPDGFLSELTPSGELQRAVRAACSLHSIGKIGGAQNRSLQQAC

SEQ ID NO: 871577 - protein, 253 aa, Homo sapiens
AVVSTQSAHYGRGRRVRHVPLRGSPGPSAIMPMFIVNTNVPRASVPDGFLSELTQQLAQATWQAPPSTSRCTWSRTSSMAFGRAPASRARCLQPAQHRQDRRRAEPLLTASLLMLACWPEARLRISSPDQGLHQLLRHERGQCGLEQLHLRLRAAGTHAVCAGSTREPAARCVLGPPTPTFWWGEINGLETSAEIRHELAVAYLGCRVEAKADLPHGPRQGPSDESLTQASTNRSGTSRGTPICRWLLWCCAP

SEQ ID NO: 871578 - protein, 196 aa, Homo sapiens
RKDNDRRILVYAVEAVLTSDLLLRAIMPMFIVNTNVPRASVPDGFLSELTQQLAQATGSPPSTSRCTWSRTSSMAFGRAPASRARCLQPAQHRQDRRRAEPLLTASLLMLACWPEARLRISSPDQGLHQLLRHERGQCGLEQLHLRLRAAGTHAVCAGSTREPAARCVLGPPTPTFWWGEINGLETKKTKKKNWGV

SEQ ID NO: 871579 - protein, 78 aa, Homo sapiens
ARSSAAAAARASVPLRGSPGPSACTASARSAARRTAPTASCCAACWPSACASARTGRVYINYYDMNAANVGWNNSTFA

SEQ ID NO: 871580 - protein, 121 aa, Homo sapiens; identical to SEQ ID NO: 871541

SEQ ID NO: 871581 - protein, 121 aa, Homo sapiens; identical to SEQ ID NO: 871541

SEQ ID NO: 871582 - protein, 121 aa, Homo sapiens; identical to SEQ ID NO: 871541

SEQ ID NO: 871583 - protein, 276 aa, Homo sapiens
APLSPLGAARCPSLRAQAAGSPLANGSRGLPGTARPPLRPLFRMLHALLRSRMIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLSTSRCTWSRTSSWLRASSSEPCALLAACTASARSAARRTAPYSKLADAGLLA

SEQ ID NO: 871584 - protein, 237 aa, Homo sapiens; identical to SEQ ID NO: 871556

SEQ ID NO: 871585 - protein, 286 aa, Homo sapiens
APLSPLGAARCPSLRAQAAGSPLANGSRGLPGTARPPLRPLFRMLHALLRSRMIQGRILLLTICAAGIGGTFQFGYNLSIINAPTLHIQEFTNETWQARTGEPLPDHLVLLMWSLIVSLYPLGGLFGALLAGPLAITLGASLSVFSLPPRKKSLLVNNIFVVSAAILFGFSRKAGSFEMIMLGRLLVGVNAGVSMNIQPMYLGESAPKELRGAVAMSSAIFTALGIVMGQVVGLSTSRCTWSRTSSWLRARSSEPCALLAACTASARSAARRTAPYSKLADAGLLA

SEQ ID NO: 871586 - protein, 542 aa, Homo sapiens
APLSPLGAARCPSLRAQAAGSPLANGSRGLPGTARPPLRPLFRMLHALLRSRMIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 871587 - protein, 503 aa, Homo sapiens
MEDELEPSLRPRTQIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 871588 - protein, 492 aa, Homo sapiens
APLSPLGAARCPSLRAQAAGSPLANGSRGLPGTARPPLRPLFRMLHALLRSRMIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLSTTGLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 871589 - protein, 496 aa, Homo sapiens; identical to SEQ ID NO: 871558

SEQ ID NO: 871590 - protein, 151 aa, Homo sapiens; identical to SEQ ID NO: 871557

SEQ ID NO: 871591 - protein, 276 aa, Homo sapiens; identical to SEQ ID NO: 871583

SEQ ID NO: 871592 - protein, 203 aa, Homo sapiens
MPMFIVNTNVPRASVPDGFLSELTQQLAQATWQAPPSTSRCTWSRTSSMAFGGSSEPCALCSLHSIGKIGGAQNRSYSKLLCGLLAERLRISPDRQGLHQLLRHERGQCGLEQLHLRLRAAGTHAVCAGSTREPAARCVLGPPTPTFWWGEINGLETTDTSGGARYQFAYSESFTIPGRVYTSCWRTWVTTYRWSPLAGGMRG

SEQ ID NO: 871593 - protein, 285 aa, Homo sapiens
APLSPLGAARCPSLRAQAAGSPLANGSRGLPGTARPPLRPLFRMLHALLRSRMIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLSTTAAPGLRGLGRGAGGAGGGARCLPGLPCPAPMGAVPASGPEETGDKPRGSGQCHGALRE

SEQ ID NO: 871594 - protein, 115 aa, Homo sapiens; identical to SEQ ID NO: 871559

SEQ ID NO: 871595 - protein, 106 aa, Homo sapiens
AAMASWGMATEAAALWGNAEHCNAPRLPSKEDRPLGLASGAAWPGVSSMLEPQTCFPACLRVPCKGLADQGGSGMGLQPPPSTSFIHLANINEAMCQGPCSQQEKS

SEQ ID NO: 871596 - protein, 773 aa, Homo sapiens
TYVVHTWSGVVQAGVFGRAWEHKSLFHHVSRTSHSGPGLVAKMVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871597 - protein, 731 aa, Homo sapiens
MVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871598 - protein, 773 aa, Homo sapiens; identical to SEQ ID NO: 871596

SEQ ID NO: 871599 - protein, 841 aa, Homo sapiens
TYVVHTWSGVVQAGVFGRAWEHKSLFHHVSRTSHSGPGLVAKMVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKPWHLTFHALLGFPGLLCILCPWSPCSFYVLWLERALPKFKLQIPGQTSAPEGSRGTRLPYQILKASCSLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871600 - protein, 686 aa, Homo sapiens
IFGSLTSTMAVGKNKRLTKGGKKGAKKKVVDPFSKKDWYDVKAPAMFNIRNIGKTLVTRTQGTKIASDGLKGRVFEVSLADLQNDEVAFRKFESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871601 - protein, 502 aa, Homo sapiens [sequence omitted]

SEQ ID NO: 871602 - protein, 378 aa, Homo sapiens
MRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871603 - protein, 334 aa, Homo sapiens
FEFELGSRIQKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871604 - protein, 103 aa, Homo sapiens
MYTMEDYSAIQRNTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871605 - protein, 773 aa, Homo sapiens; identical to SEQ ID NO: 871596

SEQ ID NO: 871606 - protein, 687 aa, Homo sapiens
MKCHMRPITGCQCMRVGSMHGDLQVAVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871607 - protein, 560 aa, Homo sapiens
RLGRGRGVIGLVLTELVLRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871608 - protein, 438 aa, Homo sapiens
WLVSRGNRTRLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871609 - protein, 455 aa, Homo sapiens
TYVVHTWSGVVQAGVFGRAWEHKSLFHHVSRTSHSGPGLVAKMVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISNIQGTE

SEQ ID NO: 871610 - protein, 263 aa, Homo sapiens
FDGDSHCVLGGSAYPADVTSTPSQMQSPLQQAAGRLSQGTEDKLFHPRPHLSCKPPLCHLLEVLQLCNLHVCLRFIFIYISVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 871611 - protein, 101 aa, Homo sapiens
AIRSARTLRPSERPYEHRTKHSVNDSFPVVFPALGKTYSEHQNLMLLQKYIAALSLFSRKGKNKWALELNPDLLVVSRPGKGSTQEPGLNENSDQGIEAFL

SEQ ID NO: 871612 - protein, 105 aa, Homo sapiens
TIMWIEGGYKSLEPAEAKRSGLFPPQLLRGPRSLEGIPGNNNNSNKTSSGNGFLCNSYCGFCMYLRLPPWVIAPLFEIQMVLSMTQIQSQLHLHSHTMTKLPDCH

SEQ ID NO: 871613 - protein, 117 aa, Homo sapiens
PRRTSAPGALLSGATSSGGPLASYQKANMDNAHPGALLWNGVQFSGTEKVLRCVLLVESTIVTGDWMSSGQADGLFRRGFIGARGLSWALQGCSLGRGERENSRKGTVKSCQKCAWV

SEQ ID NO: 871614 - protein, 316 aa, Homo sapiens
LRDEINEKQKTIDELKDLNQKLQLELEKLQADYEKLKSEEHEKSTKLQELTFLYERHEQSKQDLKGLEETVARELQTLHNLRKLFVQDVTTRVKKSAEMEPEDSGGIHSQKQKISFLENNLEQLTKVHKQLVRDNADLRCELPKLEKRLRATAERVKALEGALKEAKEGAMKDKRRYQQEVDRIKEAVRYKSSGKRGHSAQIAKPVRPGHYPASSPTNPYGTRSPECISYTNSLFQNYQNLYLQATPSSTSDMYFANSCTSSGATSSGGPLASYQKANMDNGNATDINDNRSDLPCGYEAEDQAKLFPLHQETAAS

SEQ ID NO: 871615 - protein, 316 aa, Homo sapiens; identical to SEQ ID NO: 871614

SEQ ID NO: 871616 - protein, 316 aa, Homo sapiens; identical to SEQ ID NO: 871614

SEQ ID NO: 871617 - protein, 316 aa, Homo sapiens; identical to SEQ ID NO: 871614

SEQ ID NO: 871618 - protein, 301 aa, Homo sapiens
MKSGPGIQAAIDLTAGAAGGTACVLTGQPFDTIKVKMQTFPDLYKGLTDCFLKTYAQVGLRGFYKGTGPALMAYVAENSVLFMCYGFCQQFVRKVAGMDKQAKLSDLQTAAAGSFASAFAALALCPTELVKCRLQTMYEMEMSGKIAKSHNTIWSVVKGILKKDGPLGFYHGLSSTLLQEVPGYFFFFGGYELSRSFFASGRSKDELGPVHLMLSGGVAGICLWLVVFPVDCIKSRIQVLSMYGKQAGFIGTLLSVVRNEGIVALYSGLKATMIRAIPANGALFVAYEYSRKMMMKQLEAY

SEQ ID NO: 871619 - protein, 94 aa, Homo sapiens
MLKNRELLKIFEQASHMMKLIEEHCICDCIWMEWEDLEAKTLDRRPPEQTRRERCSCGNGKRWAKPKITTEKKNHPDFMIDWMYFETPLSIQMK

SEQ ID NO: 871620 - protein, 175 aa, Homo sapiens
RHSADLLSQSGRAESPTKTAGWNKEQQGSWADRSPLHEAASQGRLLALRTLLSQGYNVNAVTLDHVTPLHEACLGDHVACARTLLEAGANVNAITIDGVTPLFNACSQGSPSCAELLLEYGAKAQLESCLPSPTHEAASKGHHECLDILISWGIDVDQEIPHLGDSSLCSLYVTA

SEQ ID NO: 871621 - protein, 213 aa, Homo sapiens
MSVLEENRPFAQQLSNVYFTILSLFCFKLFVKISLAILSHFYIVKGNRKEAARIAAEFYGVTQGQGSWADRSPLHEAASQGRLLALRTLLSQGYNVNAVTLDHVTPLHEACLGDHVACARTLLEAGANVNAITIDGVTPLFNACSQGSPSCAELLLEYGAKAQLESCLPSPTHEAASKGHHECLDILISWGIDVDQEIPHLGDSSLCSLYVTA

SEQ ID NO: 871622 - protein, 110 aa, Homo sapiens [sequence omitted]

SEQ ID NO: 871623 - protein, 364 aa, Homo sapiens
IISRQAAEGGRVEGPPLRPPATSRRWAGPTLWRMEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLELVTKEDPKALAVALNWDIKKTETVQEACERELALRLQQTQSLHSLRSISASKASPPGDLQNPKRARQDPT

SEQ ID NO: 871624 - protein, 301 aa, Homo sapiens
IISRQAAEGGRVEGPPLRPPATSRRWAGPTLWRMEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLEVGGNQGH

SEQ ID NO: 871625 - protein, 184 aa, Homo sapiens [sequence omitted]

SEQ ID NO: 871626 - protein, 486 aa, Homo sapiens
RASPWRCVPRGTWCLPPLPAARFPAPSWRRLPAFVRPSEVSLQLAPPVAPFFRVDHTRVIVCVHRYNSLQGPEPGHLTTLNPGLKRILQRFVFSRTFLFAGHDFPPPLSSYVSLQNNYFRIRHVTLHRVRPPRSTDRGNDRRLPPPWSRRPTLWRMEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLELVTKEDPKALAVALNWDIKKTETVQEACERELALRLQQTQSLHSLRSISASKASPPGDLQNPKRARQDPT

SEQ ID NO: 871627 - protein, 301 aa, Homo sapiens; identical to SEQ ID NO: 871624

SEQ ID NO: 871628 - protein, 263 aa, Homo sapiens
YGMVRPGGESAEANTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLELVTKEDPKALAVALNWDIKKTETVQEACERELALRLQQTQSLHSLRSISASKASPPGDLQNPKRARQDPT

SEQ ID NO: 871629 - protein, 69 aa, Homo sapiens
MLVDAPCSDLAQELRQSCATVQRLQHTLQQVLDQREEVRQSKQLLQLYLQALEKEGSLLSKQEGRTLCR

SEQ ID NO: 871630 - protein, 217 aa, Homo sapiens
MCPLWRLLIFLGLLALPLAPHKQPWPGLAQAHRDNKSTLARIIAQGLIKHNAESRIQNIHFGDRLNASAQVAPGLVGWLISGRKHQQQQESRSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 871631 - protein, 253 aa, Homo sapiens
MCPLWRLLIFLGLLALPLAPHKQPWPGLAQAHRDNKSTLARIIAQGLIKHNAESRIQNIHFGDRLNASAQVAPGLVGWLISGRKHQQQQESSINITNIQLDCGGIQISFHKEWFSANISLEFDLELRPSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 871632 - protein, 209 aa, Homo sapiens
MCPLWRLLIFLGLLALPLAPHKQPWPGLAQAHRDNKSTLARIIAQGLIKHNAESRIQNIHFGDRLNASAQVAPGLVGWLISGRKHQQQQESSINITNIQLDCGGIQISFHKEWFSANISLEFDLELRPSFDNNIVKMCAHMSIVVEFWLEKDEFGRRDLVIGKCDAEPSSVHVAILTEAIPPKMNQFLYNLKENLQKVLPHMVESQPLA

SEQ ID NO: 871633 - protein, 182 aa, Homo sapiens
MPHFEQLLPATPSAVIAQGLIKHNAESRIQNIHFGDRLNASAQVAPGLVGWLISGRKHQQQQESSINITNIQLDCGGIQISFHKEWFSANISLEFDLELRPSFDNNIVKMCAHMSIVVEFWLEKDEFGRRDLVIGKCDAEPSSVHVAILTEAIPPKMNQFLYNLKENLQKVLPHMVESQPLA

SEQ ID NO: 871634 - protein, 112 aa, Homo sapiens
KVAPGQQGQIFLMHLDLLQTFFVRCTTHFKTALQGSPMYSGGPRHTQAGDPSSLRSRWPQPDTSYPAESHNPSQKSPNTSADQRWGSQARSFTHNDRLLGDIAGPLFLSSPC

SEQ ID NO: 871635 - protein, 112 aa, Homo sapiens; identical to SEQ ID NO: 871634

SEQ ID NO: 871636 - protein, 112 aa, Homo sapiens; identical to SEQ ID NO: 871634

SEQ ID NO: 871637 - protein, 292 aa, Homo sapiens
GGSGRGQISFWGKPLTLAPCHRPGSVPPSFHFPPSLPPVPQPLAERRVLPAGIAGNTKRWFLFFKTSVSWEGVWRGRMSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADF

SEQ ID NO: 871638 - protein, 135 aa, Homo sapiens
MTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADF

SEQ ID NO: 871639 - protein, 128 aa, Homo sapiens
AWHRVSAQQMLATGGFLSQRDVHKCFCVGVWASNYVALNQRTYQCINSLWMSDLVGGSVQRQGQEWRFVCERPLVSIRACVCLCSHVNLHIVCAKGVSMSFIHVRISSLTFAVSVPSASPGIHTDAIL

SEQ ID NO: 871640 - protein, 190 aa, Homo sapiens
GEEAPRRRRRRAEERRSGRPGHRAAAERAAARRSFPTAARRTPAAAMSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLGE

SEQ ID NO: 871641 - protein, 230 aa, Homo sapiens
MVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 871642 - protein, 405 aa, Homo sapiens
GEEAPRRRRRRAEERRSGRPGHRAAAERAAARRSFPTAARRTPAAAMSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 871643 - protein, 305 aa, Homo sapiens
MAPYGPLAASSLLSQQYAASLGLEKLVSPPASAAASSPSSSPSPQPVSELDLSSEPQQLTAKGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 871644 - protein, 163 aa, Homo sapiens
MAPYGPLAASSLLSQQYAASLGLEKLVSPPASAAASSPSSSPSPQPVSELDLSSEPQQLTAKGAGFPSIPVGKSPMVEQAVQTGSADNLNAKKLLPGKGTTGTQLNGRQAQPSSKTASDVVQPAAVQAQGQVNDENRRPQRRRSGGDKDPRTERMTVGTRRQG

SEQ ID NO: 871645 - protein, 133 aa, Homo sapiens
AIIFQKTKNKTKQKKELHGQVKLELKCCGKGSSHHTGNLHPKGSSSISRVQADGTVLVSQLNKRPDEGVRGDGMAFAVLTRCLVVQSSLGSASASPFQPHVPYSPFRGMAPYGPLAASSLLSQQYAASLGLGE

SEQ ID NO: 871646 - protein, 305 aa, Homo sapiens; identical to SEQ ID NO: 871643

SEQ ID NO: 871647 - protein, 266 aa, Homo sapiens
MAPYGPLAASSLLSQQYAASLGLGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 871648 - protein, 431 aa, Homo sapiens
GEEAPRRRRRRAEERRSGRPGHRAAAERAAARRSFPTAARRTPAAAMSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 871649 - protein, 374 aa, Homo sapiens
AIIFQKTKNKTKQKKELHGQVKLELKCCGKGSSHHTGNLHPKGSSSISRVQADGTVLVSQLNKRPDEGVRGDGMAFAVLTRCLVVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 871650 - protein, 575 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871651 - protein, 556 aa, Homo sapiens
RRRRSGLEHVRPFVLRSCVCPGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871652 - protein, 629 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKCEAWGIEGVGQQTGGPDSLALNPWETLVGSETLTFLSADTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871653 - protein, 549 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPDTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871654 - protein, 533 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPDTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871655 - protein, 318 aa, Homo sapiens
MHACVQRKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871656 - protein, 344 aa, Homo sapiens
TLSLWGDALCGVTLSLWGDALSVGGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871657 - protein, 207 aa, Homo sapiens
VDGGYTGIGYLGVLVNGDPRPSAAGVTYFSPSKSKNDSKAGGAFMLPPPLRPDPKCPPPPPPRRVERHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871658 - protein, 354 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTRASPTERASPHRESVTPQRER

SEQ ID NO: 871659 - protein, 336 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEGEGGVRSSTWSPRCADWPHGPLISSPP

SEQ ID NO: 871660 - protein, 47 aa, Homo sapiens
LPSTRLCSGTCQPTQFRCSNGCCIDSFLECDDTPNCPDASDEAACEK

SEQ ID NO: 871661 - protein, 550 aa, Homo sapiens
ADQVCLLLCPLPSSQGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871662 - protein, 591 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871663 - protein, 566 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871664 - protein, 397 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSVLWHLSAHPVPLQQWLLHRQFPGV

SEQ ID NO: 871665 - protein, 575 aa, Homo sapiens; identical to SEQ ID NO: 871650

SEQ ID NO: 871666 - protein, 209 aa, Homo sapiens
MAQNLKDLAGRLPAGPRGMGTALKLLLGAGAVAYGVRESVFTVEGGHRAIFFNRIGGVQQDTILAEGLWHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871667 - protein, 243 aa, Homo sapiens
WVLAERGFLAEEQEFNQKGQIPCHHLTLQTPPSSHLSSPLLQQGQNQQQGLQSLGQQSGYSPTSRYTGKLANTLGNDVFNVFSIQLTDNLVEPVVVCKEPSLGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 871668 - protein, 350 aa, Homo sapiens
GEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLAACSRDRKITTTICLPPRSSEAAGSGASAVLWRVSSG

SEQ ID NO: 871669 - protein, 68 aa, Homo sapiens
YLPYQHTGVHHTPQPTPTAIEDGALAGTEPKIPHPHQHLTLDLMLQRGKGTLLYPEGPLLLGEHREGT

SEQ ID NO: 871670 - protein, 130 aa, Homo sapiens
GLRLWGAQSPPGGQGRWRPLKLLGVFGVRAAPVPAGRLGASHTQTPLRASPAGRLPGLAVAGRGRVGGGCGRPAGSARGSPRQTANGGGARGARGDAALVGGAARPEPRASGHVIRYSQVDCRGEEPSYT

SEQ ID NO: 871671 - protein, 130 aa, Homo sapiens
MAAVLGALGATRRLLAALRGQSLGLAAMSSGTHRLTAEERNQAILDLKAAGWSELSERDAIYKEFSFHNFNQAFGFMSRVALQAEKMNHHPEWFNVYNKVQITLTSHDCGELTKKDVKLAKFIEKAAASV

SEQ ID NO: 871672 - protein, 103 aa, Homo sapiens
MSSGTHRLTAEERNQAILDLKAAGWSELSERDAIYKEFSFHNFNQAFGFMSRVALQAEKMNHHPEWFNVYNKVQITLTSHDCGELTKKDVKLAKFIEKAAASV

SEQ ID NO: 871673 - protein, 130 aa, Homo sapiens; identical to SEQ ID NO: 871671

SEQ ID NO: 871674 - protein, 130 aa, Homo sapiens; identical to SEQ ID NO: 871670

SEQ ID NO: 871675 - protein, 965 aa, Homo sapiens
MGSLLSCRLECSGVITAHCNLQRLDSSDPPALASLVAGTTGACHHTHLIFFIFIFCRDSLTILLGLVLNSWAQVILLPQPPMGNLYFLFFFFLEMEFRSCRPGWSAMARSWLTAVSTSWVQVILHPRPTEVAEITGNCHHARLICVFFFSKRWGFAMLAGLVLTPDLKRPACLGLPKCWDYRHEPLCLVADFYFLFFFYRWGSHYAAQADLKLLASSDPPTLASQVAGIISVSHYPYLTITFFASLVFFCSKQTHHNLFLSFQVFSSAVPWMCSLSLRAQRTCFSPLYMTLNFFYHIIKGLVSISWGHFLKGGPLCGLFLVTSSFNPEPHDCWVPIAFLLNGGTQSPWEERIHDRPTWELPTSGAYTLVMQQNAQEGPHKARIPFVAPSLLPLRIQTLRKIPKQRFSVGCKKQGIKVENLENVINTVTSATRESFLVHQLTLHRWDFAQHSRNLSKYYLSPLPVKKCASRSVRAGCQCSLSLFPQILSAYQNKLHVLDNLVSMIGGGWHAITFMCPVDLNDQFDQFDCYDNQKAFLFFYNRPHLKSDNENYISLYIRKVYTFWLGTVAHACNPCTLRGWGGSLEVRSLRPPGQRGETPSLLKIHRLARSDGVHLLSQLLRMLRQENPFNLGGEGCSEPGLHHCTPAWVTERDSVSEKKKKEEEKEKYIFYIFLTYENVFISFVTYNGKQYTYSEKNCKAQINGNKQEKESPITSPSKTDTVKILAYFLLIFSTADFCTGEIILNREFCIFGFCVLLHTKTKDIKMDINIFLNPEKCIDIFECLYFTRWTYHNLLTQSFLLDVEVVFKLLSAGKNTEIDMFSGSYFISGYIILGQRMNGSQAFQKSWSVFMPLAVFESAQSYYTVASIRSYHIEVIANFINKNNGFTLHLPDWYCCRTYLEKFVCLWCLFHEYDCVPIFSWGIQFFITDVSMCMGDYLMIISLLSRLAIFSLAVTVFPVPTRLLDM

SEQ ID NO: 871676 - protein, 80 aa, Homo sapiens
GDLEDPQALRGQSLGLAAMSSGTHRLTAEERNQAILDLKAAGWSELSERDAIYKEFSFHNFNQHLALCPELPNKRLPGAC

SEQ ID NO: 871677 - protein, 130 aa, Homo sapiens; identical to SEQ ID NO: 871671

SEQ ID NO: 871678 - protein, 130 aa, Homo sapiens; identical to SEQ ID NO: 871671

SEQ ID NO: 871679 - protein, 172 aa, Homo sapiens
RTGSSQCRLRQLESKPLKMADDLDFETGDAGASATFPMQCSALRKNGFVVLKGWPCKIVEMSASKTGKHGHAKVHLVGIDIFTGKKYEDICPSTHNMDVPNIKRNDFQLIGIQDGYLSLLQDSGEVPEDLRLPEGDLGKEIEQKYDCGEEILITVLSAMTEEAAVAIKAMAK

SEQ ID NO: 871680 - protein, 493 aa, Homo sapiens
MRGFGPGLTARRLLPLRLPPRPPGPRLASGQAAGALERAMDELLRRAVPPTPAYELREKTPAPAEGQCADFVSFYGGLAETAQRAELLGRLARGFGVDHGQVAEQSAGVLHLRQQQREAAVLLQAEDRLRYALVPRYRGLFHHISKLDGGVRFLVQLRADLLEAQALKLVEGPDVREMNGVLKGMLSEWFSSGFLNLERVTWHSPCEVLQKISEAEAVHPVKNWMDMKRRVGPYRRCYFFSHCSTPGEPLVVLHVALTGDISSNIQAIVKEHPPSETEEKNKITAAIFYSISLTQQGLQGVELGTFLIKRVVKELQREFPHLGVFSSLSPIPGFTKWLLGLLNSQTKEHGRNELFTDSECKEISEITGGPINETLKLLLSSSEWVQSEKLVRALQTPLMRLCAWYLYGEKHRGYALNPVANFHLQNGAVLWRINWMADVSLRGITGSCGLMANYRYFLEETGPNSTSYLGSKIIKASEQVLSLVAQFQKNSKL

SEQ ID NO: 871681 - protein, 144 aa, Homo sapiens
MASTRPGGVECKEISEITGGPINETLKLLLSSSEWVQSEKLVRALQTPLMRLCAWYLYGEKHRGYALNPVANFHLQNGAVLWRINWMADVSLRGITGSCGLMANYRYFLEETGPNSTSYLGSKIIKASEQVLSLVAQFQKNSKL

SEQ ID NO: 871682 - protein, 493 aa, Homo sapiens; identical to SEQ ID NO: 871680

SEQ ID NO: 871683 - protein, 475 aa, Homo sapiens
MRGFGPGLTARRLLPLRLPPRPPGPRLASGQAAGALERAMDELLRRAVPPTPAYELREKTPAPAEGQCADFVSFYGGLAETAQRAELLGRLARGFGVDHGQVAEQSAGVLHLRQQQREAAVLLQAEDRLRYALVPRYRGLFHHISKLDGGVRFLVQLRADLLEAQALKLVEGPDVREMNGVLKGMLSEWFSSGFLNLERVTWHSPCEVLQKISEAEAVHPVKNWMDMKRRVGPYRRCYFFSHCSTPGEPLVVLHVALTGDISSNIQAIVKEHPPSETEEKNRVELGTFLIKRVVKELQREFPHLGVFSSLSPIPGFTKWLLGLLNSQTKEHGRNELFTDSECKEISEITGGPINETLKLLLSSSEWVQSEKLVRALQTPLMRLCAWYLYGEKHRGYALNPVANFHLQNGAVLWRINWMADVSLRGITGSCGLMANYRYFLEETGPNSTSYLGSKIIKASEQVLSLVAQFQKNSKL

SEQ ID NO: 871684 - protein, 106 aa, Homo sapiens
ARLRARLDGQASPPAAVAPAAARAPAGERAGGRRPGAGHGRAVWRINWMADVSLRGITGSCGLMANYRYFLEETGPNSTSYLGSKIIKASEQVLSLVAQFQKNSKL

SEQ ID NO: 871685 - protein, 197 aa, Homo sapiens
MAENNLKMLKIQQCVVANKLPRNRPYVCNICFKHFETPSKLARHYLIHTGQKPFECDVCHKTFRQLVHLERHQLTHSLPFKCSICQRHFKNLKTFVKHQQLHNETYQNNVKQVRRLLEAKQEKSMYGVYNTFTTEERWALHPCSKSDPMYSMKRRKNIHACTICGKMFPSQSKLDRHVLIHTGQRPFKCVLCTKSFR

SEQ ID NO: 871686 - protein, 158 aa, Homo sapiens
GIVACPHCPLRMRSHPGAQLFPRSGPTHPASLHQRSPAACPPTLGAFWLAVLLADMRQRLLPSVTSLLLVALLFPGSSQARHVNHSATEALGELRERAPGQGTNGFQLLRHAVKRDLLPPRTPPYQVHISHQEARGPSFKICVGFLGPRWARGCSTGN

SEQ ID NO: 871687 - protein, 188 aa, Homo sapiens
GIVACPHCPLRMRSHPGAQLFPRSGPTHPASLHQRSPAACPPTLGAFWLAVLLADMRQRLLPSVTSLLLVALLFPGSSQARHVNHSATEALGELRERAPGQGTNGFQLLRHAVKRDLLPPRTPPYQGDVPPGIRNTICRMQQGICRLFFCHSGEKKRDICSDPWNRCCVSNTDEEGKEKPEMDGRSGI

SEQ ID NO: 871688 - protein, 82 aa, Homo sapiens
MRQRLLPSVTSLLLVALLFPGSSQARHVNHSATEALGELRERAPGQGTNGFQLLRHAVKRDLLPPRTPPYQGTGQQHRQRCG

SEQ ID NO: 871689 - protein, 100 aa, Homo sapiens
CQAEASEHPQTCVSTCTGSSQARHVNHSATEALGELRERAPGQGTNGFQLLRHAVKRDLLPPRTPPYQVHISHQEARGPSFKICVGFLGPRWARGCSTGN

SEQ ID NO: 871690 - protein, 157 aa, Homo sapiens
MRQRLLPSVTSLLLVALLFPGSSQARHVNHSATEALGELRERAPGQGTNGFQLLRHAVKRDLLPPRTPPYQGDVPPGIRNTICRMQQGICRLFFCHSGDRPAAQTTLWIRRVETSSSCLLSSGVVTAGWPRWIGFRGQEAALCSRRAGASPRVCGSD

SEQ ID NO: 871691 - protein, 158 aa, Homo sapiens; identical to SEQ ID NO: 871686

SEQ ID NO: 871692 - protein, 103 aa, Homo sapiens
MRQRLLPSVTSLLLVALLFPGSSQARHVNHSATEALGELRERAPGQGTNGFQLLRHAVKRDLLPPRTPPYQVHISHQEARGPSFKICVGFLGPRWARGCSTGN

SEQ ID NO: 871693 - protein, 103 aa, Homo sapiens; identical to SEQ ID NO: 871692

SEQ ID NO: 871694 - protein, 102 aa, Homo sapiens
MLTARGGSRSAERKGDLQRTFRQVCVCSLSCLAPQRWGARGSEAVPVSARESGKGSRAPPETRVRAEPESSPGTSAVAPPLPSPLSLPPPPPGVVKATICPE

SEQ ID NO: 871695 - protein, 151 aa, Homo sapiens
RALGPWRRRTGLGATAHDAVLEPPGRSVTAPKRERAESPPPTAGPPQNRKPCADRGSPPPCSEKSADPRDRSKGRGKTGMGGKQGGPAEGKLRLRKRSEAASPDSRNVHVDCPRRKSIGRAEGGPAEDLPTGWSDHAHGSSSRLHYECRIC

SEQ ID NO: 871696 - protein, 284 aa, Homo sapiens
MSLVDLGKRLLEAARKGQDDEVRTLMANGAPFTTDWLGTSPLHLAAQYGHYSTAEVLLRAGVSRDARTKVDRTPLHMAAADGHAHIVELLVRNGADVNAKDMLKMTALHWATERHHRDVVELLIKYGADVHAFSKFDKSAFDIALEKNNAEILVILQEAMQNQVNVNPERANPVTDPVSMAAPFIFTSGEVVNLASLISSTNTKTTSANTEEIIEGNSVDSSIQQVMGSGGQRVITIVTDGVPLGNIQTSIPTGGIGQPFIVTVQDGQQVLTVPAGKVAEETVI

SEQ ID NO: 871697 - protein, 266 aa, Homo sapiens
MSLVDLGKRLLEAARKGQDDEVRTLMANGAPFTTDWLGTSPLHLAAQYGHYSTAEVLLRAGVSRDARTKVDRTPLHMAAADGHAHIVELLVRNGADVNAKDMLKMTALHWATERHHRDVVELLIKYGADVHAFSKFDKSAFDIALVNVNPERANPVTDPVSMAAPFIFTSGEVVNLASLISSTNTKTTSANTEEIIEGNSVDSSIQQVMGSGGQRVITIVTDGVPLGNIQTSIPTGGIGQPFIVTVQDGQQVLTVPAGKVAEETVI

SEQ ID NO: 871698 - protein, 739 aa, Homo sapiens
AKNCVSATSAPWPRWPLGVLNLLCVLEGQALHPPNSLDLFAGPYSSWLSDPTTRLCGHSLLLGCPWCPSQRPPGASLHRPSLPSSLMAVWVTVFVFSSPGDQALMHPQEGHALRRPPPRWLLLIMVSGPLALRWCAWAGRGDMGPDMELPSHSKQLLLQLNQQRTKGFLCDVIIMVENSIFRAHKNVLAASSIYFKSLVLHDNLINLDTDMVSSTVFQQILDFIYTGKLLPSDQPAEPNFSTLLTAASYLQLPELAALCRRKLKRAGKPFGSGRAGSTGMGRPPRSQRLSTASVIQARYQGLVDGRKGAHAPQELPQAKGSDDELFLGGSNQDSVQGLGRAVCPAGGEAGLGGCSSSTNGSSGGCEQELGLDLSKKSPPLPPATPGPHLTPDDAAQLSDSQHGSPPAASAPPVANSASYSELGGTPDEPMDLEGAEDNHLSLLEAPGGQPRKSLRHSTRKKEWGKKEPVAGSPFERREAGPKGPCPGEEGEGVGDRVPNGILASGAGPSGPYGEPPYPCKEEEENGKDASEDSAQSGSEGGSGHASAHYMYRQEGYETVSYGDNLYVCIPCAKGFPSSEQLNAHVETHTEEELFIKEEGAYETGSGGAEEEAEDLSAPSAAYTAEPRPFKCSVCEKTYKDPATLRQHEKTHWLTRPFPCNICGKMFTQRGTMTRHMRSHLGLKPFACDECGMRFTRQYRLTEHMRVHSGEKPYECQLCGGKFTQQRNLISHLRMHTSPS

SEQ ID NO: 871699 - protein, 296 aa, Homo sapiens
REAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 871700 - protein, 104 aa, Homo sapiens
MSLIFQQTHDMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 871701 - protein, 56 aa, Homo sapiens
MLQDSLEHVQLFDLMRRMLEFDPAQRITLAEALLHPFFAGLTPEERSFHTSRNPSR

SEQ ID NO: 871702 - protein, 296 aa, Homo sapiens; identical to SEQ ID NO: 871699

SEQ ID NO: 871703 - protein, 296 aa, Homo sapiens; identical to SEQ ID NO: 871699

SEQ ID NO: 871704 - protein, 56 aa, Homo sapiens; identical to SEQ ID NO: 871701

SEQ ID NO: 871705 - protein, 318 aa, Homo sapiens
MSTHVAGLGLDKMKLGNPQSFLDQEEADDQQLLEPEAWKTYTERRNALREFLTSDLSPHLLKRHHARMQLLRKCSYYIEVLPKHLALGDQNPLVLPSALFQLIDPWKFQRMKKVGTAQTKIQLLLLGDLLEQLDHGRAELDALLRSPDPRPFLADWALVERRLADVSAVMDSFLTMMVPGRLHVKHRLVSDVSATKIPHIWLMLSTKMPVVFDRKASAAHQDWARLRWFVTIQPATSEQYELRFRLLDPRTQQECAQCGVIPVAACTFDVRNLLPNRSYKFTIKRAETSTLVYEPWRDSLTLHTKPEPLEGPALSHSV

SEQ ID NO: 871706 - protein, 365 aa, Homo sapiens
TRGVRREAGLWEVRARLRFRGRASGRGPGAAAGAGRGGLGVSRSSRIMSTHVAGLGLDKMKLGNPQSFLDQEEADDQQLLEPEAWKTYTERRNALREFLTSDLSPHLLKRHHARMQLLRKCSYYIEVLPKHLALGDQNPLVLPSALFQLIDPWKFQRMKKVGTAQTKIQLLLLGDLLEQLDHGRAELDALLRSPDPRPFLADWALVERRLADVSAVMDSFLTMMVPGRLHVKHRLVSDVSATKIPHIWLMLSTKMPVVFDRKASAAHQDWARLRWFVTIQPATSEQYELRFRLLDPRTQQECAQCGVIPVAACTFDVRNLLPNRSYKFTIKRAETSTLVYEPWRDSLTLHTKPEPLEGPALSHSV

SEQ ID NO: 871707 - protein, 343 aa, Homo sapiens
PAECGGRLGSGKSARGSASEAGSRIMSTHVAGLGLDKMKLGNPQSFLDQEEADDQQLLEPEAWKTYTERRNALREFLTSDLSPHLLKRHHARMQLLRKCSYYIEVLPKHLALGDQNPLVLPSALFQLIDPWKFQRMKKVGTAQTKIQLLLLGDLLEQLDHGRAELDALLRSPDPRPFLADWALVERRLADVSAVMDSFLTMMVPGRLHVKHRLVSDVSATKIPHIWLMLSTKMPVVFDRKASAAHQDWARLRWFVTIQPATSEQYELRFRLLDPRTQQECAQCGVIPVAACTFDVRNLLPNRSYKFTIKRAETSTLVYEPWRDSLTLHTKPEPLEGPALSHSV

SEQ ID NO: 871708 - protein, 151 aa, Homo sapiens
MPQPRGGQPAWQLTPSPPPSSRIMSTHVAGLGLDKMKLGNPQSFLDQEEADDQQLLEPEAWKTYTERRNALREFLTSDLSPHLLKRHHARMQLLRKCSYYIEVLPKHLALGDQNPLVLPSALFQLIDPWKFQRMKKVGTAQTKIQLLLLGD

SEQ ID NO: 871709 - protein, 343 aa, Homo sapiens; identical to SEQ ID NO: 871707

SEQ ID NO: 871710 - protein, 343 aa, Homo sapiens; identical to SEQ ID NO: 871707

SEQ ID NO: 871711 - protein, 187 aa, Homo sapiens
MSTHVAGLGLDKMKLGNPQSFLDQEEADDQQLLEPEAWKTYTERRNALREFLTSDLSPHLLKRHHARMQLLRKCSYYIEVLPKHLALGDQNPLVLPSALFQLIDPWKFQRMKKVGTAQTRSAPSVASSPWLPAPSTSETCCPTDPISSPSRGPRPPRWCTSPGGTASPCTPSRSPWRGPPSATLSER

SEQ ID NO: 871712 - protein, 121 aa, Homo sapiens
PCNPSSRKINRSMQNWHQLENLSNFIKAMVSYGMNPVDLFEANDLFESGNMTQVQVSLLALAGKAKTKGLQSGVDIGVKYSEKQERNFDDATMKAGQCVIGLQTNKCASQSALCFVNRRGS

SEQ ID NO: 871713 - protein, 332 aa, Homo sapiens
MAGYAPGVTGCPVRPRPAARPPAMSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 871714 - protein, 333 aa, Homo sapiens
QCQAGTVLRLDCPVRPRPAARPPAMSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 871715 - protein, 309 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 871716 - protein, 309 aa, Homo sapiens; identical to SEQ ID NO: 871715

SEQ ID NO: 871717 - protein, 309 aa, Homo sapiens; identical to SEQ ID NO: 871715

SEQ ID NO: 871718 - protein, 309 aa, Homo sapiens; identical to SEQ ID NO: 871715

SEQ ID NO: 871719 - protein, 350 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQDLTLLPRLECSGTISAHCNLCLPGSRDSPSCLSLPSSWDYKVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 871720 - protein, 300 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 871721 - protein, 270 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 871722 - protein, 317 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQENRFNLEAEVVVS

SEQ ID NO: 871723 - protein, 309 aa, Homo sapiens; identical to SEQ ID NO: 871715

SEQ ID NO: 871724 - protein, 309 aa, Homo sapiens; identical to SEQ ID NO: 871715

SEQ ID NO: 871725 - protein, 309 aa, Homo sapiens; identical to SEQ ID NO: 871715

SEQ ID NO: 871726 - protein, 309 aa, Homo sapiens; identical to SEQ ID NO: 871715

SEQ ID NO: 871727 - protein, 309 aa, Homo sapiens; identical to SEQ ID NO: 871715

SEQ ID NO: 871728 - protein, 289 aa, Homo sapiens
NRRFRALMKRTAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 871729 - protein, 309 aa, Homo sapiens; identical to SEQ ID NO: 871715

SEQ ID NO: 871730 - protein, 211 aa, Homo sapiens
GAEAVSARMDPKQTTLLCLWCSVWARGFRHRKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 871731 - protein, 71 aa, Homo sapiens
AAILPLVPREVRGLALEPACAPQWTRERVPRARRAQEPRTPGAGDFGGGSGKRKAVSGEDPILGLLRLPKT

SEQ ID NO: 871732 - protein, 98 aa, Homo sapiens
GPRRRHSGRRAHLDGAARPPLPEIKGRASGPRNPPRRLKASPSQTRFKGPSGGEECRRGLFSATPPSRVLRDSRHGLGEHTISYQIRFSTLPTQVISV

SEQ ID NO: 871733 - protein, 441 aa, Homo sapiens
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 871734 - protein, 441 aa, Homo sapiens; identical to SEQ ID NO: 871733

SEQ ID NO: 871735 - protein, 457 aa, Homo sapiens
SEDYPAALPNHKPKGTFKDYVRDRADLNKDKPVIPAAALAGHTDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 871736 - protein, 354 aa, Homo sapiens
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 871737 - protein, 441 aa, Homo sapiens; identical to SEQ ID NO: 871733

SEQ ID NO: 871738 - protein, 441 aa, Homo sapiens; identical to SEQ ID NO: 871733

SEQ ID NO: 871739 - protein, 441 aa, Homo sapiens; identical to SEQ ID NO: 871733

SEQ ID NO: 871740 - protein, 246 aa, Homo sapiens
RRGSRWRASSPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 871741 - protein, 441 aa, Homo sapiens; identical to SEQ ID NO: 871733

SEQ ID NO: 871742 - protein, 105 aa, Homo sapiens
MVKTAYFRYKSLLSLLANPLFPGYGIEHAQCVPPSEFSEPSFITESYQTLHPISSEELLSLKYENDYPSVILRDPLQTDTLQNDYFAIKQEVVTPDNMCMGRTSR

SEQ ID NO: 871743 - protein, 294 aa, Homo sapiens
MNSELDYYEKFEEVHGILMYKDFVKYWDNVEAFQARPDDLVIATYPKSGTTWVSEIVYMIYKEGDVEKCKEDVIFNRIPFLECRKENLMNGVKQLDEMNSPRIVKTHLPPELLPASFWEKDCKIIYLCRNAKDVAVSFYYFFLMVAGHPNPGSFPEFVEKFMQGQVPYGSWYKHVKSWWEKGKSPRVLFLFYEDLKEDIRKEVIKLIHFLERKPSEELVDRIIHHTSFQEMKNNPSTNYTTLPDEIMNQKLSPFMRKGITGDWKNHFTVALNEKFDKHYEQQMKESTLKFRTEI

SEQ ID NO: 871744 - protein, 294 aa, Homo sapiens; identical to SEQ ID NO: 871743

SEQ ID NO: 871745 - protein, 208 aa, Homo sapiens
MNSELDYYEKFEEVHGILMYKDFVKYWDNVEAFQARPDDLVIATYPKSGTTWVSEIVYMIYKEGDVEKCKEDVIFNRIPFLECRKENLMNGVKQLDEMNSPRIVKTHLPPELLPASFWEKDCKIIYLCRNAKDVAVSFYYFFLMVAGHPNPGSFPEFVEKFMQGQVPYGSWYKHVKSWWEKGKSPRVLFLFYEDLKEELQETGKITLQ

SEQ ID NO: 871746 - protein, 294 aa, Homo sapiens; identical to SEQ ID NO: 871743

SEQ ID NO: 871747 - protein, 236 aa, Homo sapiens; identical to SEQ ID NO: 751861

SEQ ID NO: 871748 - protein, 236 aa, Homo sapiens; identical to SEQ ID NO: 751861

SEQ ID NO: 871749 - protein, 236 aa, Homo sapiens; identical to SEQ ID NO: 751861

SEQ ID NO: 871750 - protein, 236 aa, Homo sapiens; identical to SEQ ID NO: 751861

SEQ ID NO: 871751 - protein, 236 aa, Homo sapiens; identical to SEQ ID NO: 751861

SEQ ID NO: 871752 - protein, 236 aa, Homo sapiens; identical to SEQ ID NO: 751861

SEQ ID NO: 871753 - protein, 236 aa, Homo sapiens; identical to SEQ ID NO: 751861

SEQ ID NO: 871754 - protein, 236 aa, Homo sapiens; identical to SEQ ID NO: 751861

SEQ ID NO: 871755 - protein, 236 aa, Homo sapiens; identical to SEQ ID NO: 751861

SEQ ID NO: 871756 - protein, 236 aa, Homo sapiens; identical to SEQ ID NO: 751861

SEQ ID NO: 871757 - protein, 236 aa, Homo sapiens; identical to SEQ ID NO: 751861

SEQ ID NO: 871758 - protein, 241 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKDPSKTPWNRQKKGRISTWKPEMQQLLKHHLIVITSLLVL

SEQ ID NO: 871759 - protein, 255 aa, Homo sapiens; identical to SEQ ID NO: 751859

SEQ ID NO: 871760 - protein, 123 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFNWLSSCG

SEQ ID NO: 871761 - protein, 177 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKHKKQVDTSRDHVRE

SEQ ID NO: 871762 - protein, 205 aa, Homo sapiens
MGNGMNKILPGLYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILGKYKEQGRTEPQPGARRWSSFPALAPLTYDNYTTET

SEQ ID NO: 871763 - protein, 256 aa, Homo sapiens
MGNGMNKILPGLYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQLCMYRGTSEMQAGAPERCPQSFRTQPASWRLELKGPQRTSAPRAPSCTPSEVVTIPRAPVEATGAYPLSFSLCLVLPTSLFLSLWVTYHFLGLAYFHVLGQHLEGAVPSLA

SEQ ID NO: 871764 - protein, 124 aa, Homo sapiens
MKRTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILAAPGILKFWAFLRRL

SEQ ID NO: 871765 - protein, 184 aa, Homo sapiens
MGNGMNKILPGLYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILAAPGILKFWAFLRRL

SEQ ID NO: 871766 - protein, 83 aa, Homo sapiens
VSIPLRVSIPLRVSIPLRVSIPLRVSIPLRVSIPLRVSIPLLWRFLYLAWMPVRIPGALPHCLVGGLALVIASCERLPRTSPV

SEQ ID NO: 871767 - protein, 184 aa, Homo sapiens; identical to SEQ ID NO: 871765

SEQ ID NO: 871768 - protein, 67 aa, Homo sapiens
MTVTDFGWEDALHTVRAGRSCANPNVGFQRQLQEFEKHEVHQYRQLAEGRLCPNWVFGRLQENASTS

SEQ ID NO: 871769 - protein, 310 aa, Homo sapiens
MWSSRRCRRPSRPQGRPPQGAEGGGSPSRRGRRRRQRRWPRRQQCGQSGGAGHRRELLHVCLLSARACGPLACLTVVDGGGDRDCSTTRVAFLALPTQLLHARRRRRHLEPANTTTCLTAGGWQRQRLQCARAILPGMYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILAAPGILKFWAFLRRL

SEQ ID NO: 871770 - protein, 184 aa, Homo sapiens; identical to SEQ ID NO: 871765

SEQ ID NO: 871771 - protein, 107 aa, Homo sapiens
SLDPNSLNCTFNGLYVKSYLCLDTDIPGKQGEIHHLYSPPLCSKLRNAPIRTASGHRQCPPCTPSHLLPCMHSSSAQQLNALCAEAQTTFLRVGKKKSRRGREFSSS

SEQ ID NO: 871772 - protein, 104 aa, Homo sapiens
QICIVRKMRRIPSGRRKMIPDGYVDPHKGTKSTGNSNYTVLLCHPGWSVVVRSWLTARLVGSRGLGNEAWTPVERKNFNCTRRKYAEIDYRIFRSWPLSENMLE

SEQ ID NO: 871773 - protein, 32 aa, Homo sapiens
MPRVAVFPPQVRPLERGDPPRPAPPMPRPFCC

SEQ ID NO: 871774 - protein, 249 aa, Homo sapiens
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLPLHHPSFHHADLQCKNHLHPDTGPSSGPPRTTTESVQEQYTKSTAEDSKNDGCICHFIYCLLDSLLCPRNLVLV

SEQ ID NO: 871775 - protein, 328 aa, Homo sapiens
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLYIFRMIHLADSSGQTKVFSQCVTHCSFSQWWHQAFYNFFTFSCLFIIPLFIMLICNAKIIFTLTRVLHQDPHELQLNQSKNNIPRARLKTLKMTVAFATSFTVCWTPYYVLGIWYWFDPEMLNRLSDPVNHFFFLFAFLNPCFDPLIYGYFSL

SEQ ID NO: 871776 - protein, 383 aa, Homo sapiens
RARARGAGLGPGGAAAAPDMSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 871777 - protein, 383 aa, Homo sapiens; identical to SEQ ID NO: 871776

SEQ ID NO: 871778 - protein, 383 aa, Homo sapiens
RARARGAGLGPGGAAAAPDMSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLASSPQKLSWGCGSALERG

SEQ ID NO: 871779 - protein, 223 aa, Homo sapiens
VRRPALTPPATKVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHVSWCPPASSSLSWLSPQALWGRGWCGNAGTIWGTWDVVG

SEQ ID NO: 871780 - protein, 242 aa, Homo sapiens
RARARGAGLGPGGAAAAPDMSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMPSVSEQTGPS

SEQ ID NO: 871781 - protein, 67 aa, Homo sapiens
ARDTAGTRPASARNTGRTRPASARDTAGTRPASARDTCGNTPSLSFEILHQFFCSYIMELFLINRFN

SEQ ID NO: 871782 - protein, 520 aa, Homo sapiens
QAQRIPASVSCSSAAAFTMDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLADVRKTEGEPFDPTFVLSRSVSNIICSVLFGSRFDYDDERLLTIIRLINDNFQIMSSPWGELYDILDPRFPSLLDWVPGPHQRIFQNFKCLRDLIAHSVHDHQASLDPRSPRDFIQCFLTKMAEEKEDPLSHFHMDTLLMTTHNLLFGGTKTVSTTLHHAFLALMKYPKVQARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGEGRNQSLSGPISTYIPHPNSTCQILSLLPSTHSQLWMHRDIHSSSQLCSYRQVVTKILVKQGGEVD

SEQ ID NO: 871783 - protein, 513 aa, Homo sapiens
QAQRIPASVSCSSAAAFTMDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLADVRKTEGEPFDPTFVLSRSVSNIICSVLFGSRFDYDDERLLTIIRLINDNFQIMSSPWGELYDILDPRFPSLLDWVPGPHQRIFQNFKCLRDLIAHSVHDHQASLDPRSPRDFIQCFLTKMAEEKEDPLSHFHMDTLLMTTHNLLFGGTKTVSTTLHHAFLALMKYPKVQARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGRRLCLGELLARMELFLYLTAILQSFSLQPLGAPEDIDLTPLSSGLGNLPRPFQLCLRPR

SEQ ID NO: 871784 - protein, 265 aa, Homo sapiens
MYVGYVLDKDSPVYPGPARPASLGLGPQAYGPPAPPPAPPQYPDFSSYSHVEPAPAPPTAWGAPFPAPKDDWAAAYGPGPAAPAASPASLAFGPPPDFSPVPAPPGPGPGLLAQPLGGPGTPSSPGAQRPTPYEWMRRSVAAGGGGGSGKTRTKDKYRVVYTDHQRLELEKEFHYSRYITIRRKSELAANLGLTERQVKIWFQNRRAKERKVNKKKQQQQQPPQPPMAHDITATPAGPSLGGLCPSNTSLLATSSPMPVKEEFLP

SEQ ID NO: 871785 - protein, 265 aa, Homo sapiens; identical to SEQ ID NO: 871784

SEQ ID NO: 871786 - protein, 776 aa, Homo sapiens
MAAAGARRVLLLLLLGVLSAGLRPGALATEHYPLSLLKQELQHRQQQEAPAGGGGCSPQSGDWGDQYSAECGESSFLNFHDSCEPGCDSLLSLTILSQAKSIAKFPFATNNTNEELAIAYVLIGSGLYDEAIRHFSTMLQILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 871787 - protein, 502 aa, Homo sapiens
MMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 871788 - protein, 812 aa, Homo sapiens
MAAAGARRVLLLLLLGVLSAGLRPGALATEHYPLSLLKQELQHRQQQEAPAGGGGCSPQSGDWGDQYSAECGESSFLNFHDSCEPGCDSLLSLTILSQAKSIAKFPFATNNTNEELAIAYVLIGSGLYDEAIRHFSTMLQEEPDLVSAIYGRGIAYGKKGLHDIKNAELALFELSRVITLEPDRPEVFEQRAEILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKRFYCSQELSLTDTVCEESSRP

SEQ ID NO: 871789 - protein, 297 aa, Homo sapiens
MAAAGARRVLLLLLLGVLSAGLRPGALATEHYPLSLLKQELQHRQQQEAPAGGGGCSPQSGDWGDQYSAECGESSFLNFHDSCEPGCDSLLSLTILSQAKSIAKFPFATNNTNEELAIAYVLIGSGLYDEAIRHFSTMLQEEPDLVSAIYGRGIAYGKKGLHDIKNAELALFELSRVITLEPDRPEVFEQRAEILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYR

SEQ ID NO: 871790 - protein, 829 aa, Homo sapiens
MAAAGARRVLLLLLLGVLSAGLRPGALATEHYPLSLLKQELQHRQQQEAPAGGGGCSPQSGDWGDQYSAECGESSFLNFHDSCEPGCDSLLSLTILSQAKSIAKFPFATNNTNEELAIAYVLIGSGLYDEAIRHFSTMLQEEPDLVSAIYGRGIAYGKKGLHDIKNAELALFELSRVITLEPDRPEVFEQRAEILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 871791 - protein, 829 aa, Homo sapiens; identical to SEQ ID NO: 871790

SEQ ID NO: 871792 - protein, 658 aa, Homo sapiens
MAAAGARRVLLLLLLGVLSAGLRPGALATEHYPLSLLKQELQHRQQQEAPAGGGGCSPQSGDWGDQYSAECGESSFLNFHDSCEPGCDSLLSLTILSQAKSIAKFPFATNNTNEELAIAYVLIGSGLYDEAIRHFSTMLQEEPDLVSAIYGRGIAYGKKGLHDIKNAELALFELSRVITLEPDRPEVFEQRAEILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKVTLASEWQSMFLEEKKTNSTFLKRTQNY

SEQ ID NO: 871793 - protein, 640 aa, Homo sapiens [sequence omitted]

SEQ ID NO: 871794 - protein, 640 aa, Homo sapiens [sequence omitted]

SEQ ID NO: 871795 - protein, 583 aa, Homo sapiens
MDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 871796 - protein, 168 aa, Homo sapiens
PSGAQAVISSVNETSLMLEWTPPSDLIKSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 871797 - protein, 610 aa, Homo sapiens
MSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEPGD

SEQ ID NO: 871798 - protein, 315 aa, Homo sapiens
MSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIGKQCLKLWQKKK

SEQ ID NO: 871799 - protein, 100 aa, Homo sapiens
PLGFDDVVRLEIESNICREGGPLPNCFTTPLRQAWTTMEKVTQNFKRIKLQEVLLVELIKYKVGKPSRIAQWKLKQSSKVIKSRGLESGLVCTVTCHITF

SEQ ID NO: 871800 - protein, 622 aa, Homo sapiens
MSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 871801 - protein, 533 aa, Homo sapiens
MSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQEDDIWKSQ

SEQ ID NO: 871802 - protein, 645 aa, Homo sapiens
MSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMHQVSVLCLSASQRMWSLSIP

SEQ ID NO: 871803 - protein, 527 aa, Homo sapiens
MSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVTQNFKRIKLQEVLLVELIKYKVGKPSRIAQWKLKQSSKVIKSRGLESGLVCTVTCHITF

SEQ ID NO: 871804 - protein, 73 aa, Homo sapiens
SQKNSRIAFARPAPRLLQKLPETPWWATQPELPGAPREAERPVGSWDGSSRSLRRLHPLKEPVPTLPSRFPGR

SEQ ID NO: 871805 - protein, 153 aa, Homo sapiens
LWLCQTPGAAAPMELQDCYLSNVDGGEHPCPRLKIAPLESHHRPKRPDDPPGTLNPCPERGGAGVWIPAGSFGTGKNRGCSDRVFTKTCIRQDPGRMWVAPPLCWARRMCPHRSQILFPQWVVQDTLNFCMNWDIQNSLEQPPPSTLCLDISY

SEQ ID NO: 871806 - protein, 63 aa, Homo sapiens
MGSPAHLPKDAIAVFIVFPRVRHWLSGTRRQCTRRAPYVRCFKVPVLRKRSLVEEMSAEQITK

SEQ ID NO: 871807 - protein, 63 aa, Homo sapiens; identical to SEQ ID NO: 871806

SEQ ID NO: 871808 - protein, 63 aa, Homo sapiens; identical to SEQ ID NO: 871806

SEQ ID NO: 871809 - protein, 366 aa, Homo sapiens
MLLALNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 871810 - protein, 149 aa, Homo sapiens [sequence omitted]

SEQ ID NO: 871811 - protein, 234 aa, Homo sapiens
MGWYWWLVTDVEGGHLLLPQSTVVDVGEAFFELTQSDKIEKRILKNEQILLKKSCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 871812 - protein, 651 aa, Homo sapiens [sequence omitted]

SEQ ID NO: 871813 - protein, 672 aa, Homo sapiens [sequence omitted]

SEQ ID NO: 871814 - protein, 567 aa, Homo sapiens
MEMFTFLLTCIFLPLLRGHSLFTCEPITVPRCMKMAYNMTFFPNLMGHYDQSIAAVEMEHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLALNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQGLVQRVILLTLAWHRATICRSPVLQNQAASKVPHLCLFTRFQE

SEQ ID NO: 871815 - protein, 672 aa, Homo sapiens [sequence omitted]

SEQ ID NO: 871816 - protein, 104 aa, Homo sapiens
TGLLGLGILIPCFLLQGKFLRFLETISVAPHLRLLLQCHFSASFLTLPILLRLLYQYFIQIAGIYWCLLSHCHSDLLKNSELSYFYTLSKHNACGVGADQICSE

SEQ ID NO: 871817 - protein, 181 aa, Homo sapiens
MMPGPRPRKGPQARGQGVAAAKQMGLFMEFGPEDTLLGMDEAEDDEDLEAELLALTGEAQTTGKKPAPKGQAPLPMAHIEKLAADCMRDVEEEEEEEGLEEDAELLVVSARLVSQGSETELQEVLGVDEETEPLDGDEVADPGGSEEENGLEDTEPPVQTAVLTASAPAAQVGSGGGPLCL

SEQ ID NO: 871818 - protein, 855 aa, Homo sapiens
MMPGPRPRKGPQARGQGVAAAKQMGLFMEFGPEDTLLGMDEAEDDEDLEAELLALTGEAQTTGKKPAPKGQAPLPMAHIEKLAADCMRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGTQGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 871819 - protein, 855 aa, Homo sapiens; identical to SEQ ID NO: 871818

SEQ ID NO: 871820 - protein, 397 aa, Homo sapiens
PPLLALPVATAAAQGPREPRAVPGETRPGAPQGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 871821 - protein, 118 aa, Homo sapiens
EPSPSLLSPPLPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 871822 - protein, 855 aa, Homo sapiens; identical to SEQ ID NO: 871818

SEQ ID NO: 871823 - protein, 507 aa, Homo sapiens
MMPGPRPRKGPQARGQGVAAAKQMGLFMEFGPEDTLLGMDEAEDDEDLEAELLALTGEAQTTGKKPAPKGQAPLPMAHIEKLAADCMRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEHCGQLQLCATVWALRVDCQR

SEQ ID NO: 871824 - protein, 855 aa, Homo sapiens; identical to SEQ ID NO: 871818

SEQ ID NO: 871825 - protein, 522 aa, Homo sapiens
MPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGTQGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 871826 - protein, 937 aa, Homo sapiens
MMPGPRPRKGPQARGQGVAAAKQMGLFMEFGPEDTLLGMDEAEDDEDLEAELLALTGEAQTTGKKPAPKGQAPLPMAHIEKLAADCMRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGTQGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEVSRPLSVPPLCAHSLPVEEDLELRPHSPGLKILSSSTYSLCDLGKALSSLNYIFLIYEMVVIIPLSGWYKQQRRGKEHCDVRKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 871827 - protein, 152 aa, Homo sapiens
SGTEAWSGTEAWSGTEAWSGTEASIYLQETLSKIFVFSLQFRLTSCALHPCVADGQHQERSQAATVQEMTFPALLASEAFVHKRCCYPSTKDLLSMCTTDHDSGLSCCWPLWGSTETGWVPGAHLPAVSPCPESGRGQGHFHSSVPWSPAAP

SEQ ID NO: 871828 - protein, 855 aa, Homo sapiens; identical to SEQ ID NO: 871818

SEQ ID NO: 871829 - protein, 118 aa, Homo sapiens
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 871830 - protein, 118 aa, Homo sapiens; identical to SEQ ID NO: 871829

SEQ ID NO: 871831 - protein, 150 aa, Homo sapiens
RVYSRVLCILTRYSHFTEGVRVAPDPTPNSPSIKNVYSLYLQSNPNKAHREFLIRAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 871832 - protein, 105 aa, Homo sapiens
MPREDAHFIYGYPKKGHGHSYTTAEEAAGIGILTVILGVLLLIGCWYCRRRNGYRALMEILGWSAVVNMSHCSLDLLELKPSSCLSLQSSWDHRIKVFMLALNVP

SEQ ID NO: 871833 - protein, 118 aa, Homo sapiens; identical to SEQ ID NO: 871829

SEQ ID NO: 871834 - protein, 253 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRGKASMCCRG

SEQ ID NO: 871835 - protein, 478 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 871836 - protein, 419 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTKFLG

SEQ ID NO: 871837 - protein, 425 aa, Homo sapiens
MLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 871838 - protein, 495 aa, Homo sapiens
MLSDELESKPELLVQFVQNTSIPLGQGLVESEAKDITCLSLLPVTEASECSRLMLPEPVPWREEDGKSGCSDLNDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 871839 - protein, 495 aa, Homo sapiens; identical to SEQ ID NO: 871838

SEQ ID NO: 871840 - protein, 439 aa, Homo sapiens
RVWIGRGRSECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 871841 - protein, 478 aa, Homo sapiens; identical to SEQ ID NO: 871835

SEQ ID NO: 871842 - protein, 405 aa, Homo sapiens
MLSDELESKPELLVQFVQNTSIPLGQGLVESEAKDITCLSLLPVTEASECSRLMLPGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 871843 - protein, 472 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQETVLQPG

SEQ ID NO: 871844 - protein, 430 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDVMEELNF

SEQ ID NO: 871845 - protein, 388 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSAEPLMGSSLLEEASVPSKNLVSMNSQPSLGGESLNLPNTNSILGVDDVMEELNF

SEQ ID NO: 871846 - protein, 346 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEVLSCPIHFYLVTLLSSLMEHTVAC

SEQ ID NO: 871847 - protein, 156 aa, Homo sapiens
NERSLKALRLKDDNQSIDSVICGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 871848 - protein, 478 aa, Homo sapiens; identical to SEQ ID NO: 871835

SEQ ID NO: 871849 - protein, 431 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTEVLAEGSPRSLSSVPDVTHHLVTMQSGRQSYEVSVLTAVNPQELLNQGDLTERRT

SEQ ID NO: 871850 - protein, 478 aa, Homo sapiens; identical to SEQ ID NO: 871835

SEQ ID NO: 871851 - protein, 478 aa, Homo sapiens; identical to SEQ ID NO: 871835

SEQ ID NO: 871852 - protein, 417 aa, Homo sapiens
MQSANVTSPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 871853 - protein, 417 aa, Homo sapiens; identical to SEQ ID NO: 871852

SEQ ID NO: 871854 - protein, 453 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSHQEVEFSRCLVALKKGVMSILLLHSPFSNLSKRLSATGLQKNKLLESPLGPG

SEQ ID NO: 871855 - protein, 445 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSSLPLGCKKINYLNLPLAQAEVLSCPIHFYLVTLLSSLMEHTVAC

SEQ ID NO: 871856 - protein, 407 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVLGSSCVGAWVQSGGLWPMVDLCQSPLTGVDPPWWVLPPHFGVRGEPPVGGS

SEQ ID NO: 871857 - protein, 344 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGIRTSAIHRF

SEQ ID NO: 871858 - protein, 334 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEVPFLCEAHRRARSMAKAVTRRKPLASES

SEQ ID NO: 871859 - protein, 128 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLRGP

SEQ ID NO: 871860 - protein, 1910 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRRQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 871861 - protein, 1879 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRRQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLEYLGSFDHYAT

SEQ ID NO: 871862 - protein, 429 aa, Homo sapiens
GCLEDTIRRVLRRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 871863 - protein, 1009 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRFIVENKYNFVF

SEQ ID NO: 871864 - protein, 1944 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSETFESTPIRGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRRQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 871865 - protein, 1501 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRRQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 871866 - protein, 592 aa, Homo sapiens
MRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRRQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 871867 - protein, 1182 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISSTRPRI

SEQ ID NO: 871868 - protein, 228 aa, Homo sapiens
MERVKMINVQRLLEAAEFLERRERECEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 871869 - protein, 182 aa, Homo sapiens
MPSPRLQHSKPPRRLSRAQKHSSGSSNTSTANRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 871870 - protein, 390 aa, Homo sapiens
RSDGDRLALGPRRQSASVCPVGSFNLPYTQTHSETDTHSHTLTHTTAGSEAREVRPAFRPGAFSAPAGRVSLGARSSAGPRSPVRGRARRTPASSMGKRGRPRKEARCEGAGLAPAAPPAVPPAVAAPQPPALPEDPAGAKPRCPFSDIFNTSENSMEKHINTFLQNVQILLEAASYLEQIEKENKKCEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 871871 - protein, 222 aa, Homo sapiens [sequence omitted]

SEQ ID NO: 871872 - protein, 228 aa, Homo sapiens
MAQKDQELGDCGVERENVFLRLVRKCEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 871873 - protein, 218 aa, Homo sapiens
MERVKMINVQRLLEAAEFLERRERECEHGYASSFPSMPSPRLQHSKPPRRLSRAQKHSSGSSNTSTANRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 871874 - protein, 228 aa, Homo sapiens; identical to SEQ ID NO: 871868

SEQ ID NO: 871875 - protein, 228 aa, Homo sapiens; identical to SEQ ID NO: 871868

SEQ ID NO: 871876 - protein, 228 aa, Homo sapiens; identical to SEQ ID NO: 871868

SEQ ID NO: 871877 - protein, 231 aa, Homo sapiens
RSDGDRLALGPRRQSASVCPVGSFNLPYTQTHSETDTHSHTLTHTTAGSEAREVRPAFRPGAFSAPAGRVSLGARSSAGPRSPVRGRARRTPASSMGKRGRPRKEARCEGAGLAPAAPPAVPPAVAAPQPPALPEDPAGAKPRCPFSDIFNTSENSMEKHINTFLQNVQILLEAASYLEQIEKENKKCEHGYASSFPSMPSPRLQHSKPPRRLSRAQKHSSGSSNTSTANR

SEQ ID NO: 871878 - protein, 228 aa, Homo sapiens; identical to SEQ ID NO: 871868

SEQ ID NO: 871879 - protein, 228 aa, Homo sapiens; identical to SEQ ID NO: 871868

SEQ ID NO: 871880 - protein, 228 aa, Homo sapiens; identical to SEQ ID NO: 871868

SEQ ID NO: 871881 - protein, 112 aa, Homo sapiens
GCWEIRGRRNTDAGGGQGKGRGRENTERGKTGGEGPLNTCGVMRWGPFSGGSPRGCRDGAERPGTRRLWCRERKCLSKTCSKYTKILGLKRLFRTERVESKGEFLRQAKSMR

SEQ ID NO: 871882 - protein, 370 aa, Homo sapiens
RSDGDRLALGPRRQSASVCPVGSFNLPYTQTHSETDTHSHTLTHTTAGSEAREVRPAFRPGAFSAPAGRVSLGARSSAGPRSPVRGRARRTPASSMGKRGRPRKEARCEGAGLAPAAPPAVPPAVAAPQPPALPEDPAGAKPRCPFSDIFNTSENSMEKHINTFLQNVQILLEAASYLEQIEKENKKCEHGYASSFPSMPSPRLQHSKPPRRLSRAQKHSSGSSNTSTANRSTHNELEKNRRAHLRLCLERLKVLIPLGPDCTRHTTLGLLNKAKAHIKRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 871883 - protein, 135 aa, Homo sapiens
QLTPEEKQHGNRLWIVQQSQFHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 871884 - protein, 228 aa, Homo sapiens; identical to SEQ ID NO: 871868

SEQ ID NO: 871885 - protein, 425 aa, Homo sapiens
MSSILPFTPPIVKRLLGWKKGEQNGQEEKWCEKAVKSLVKKLKKTGQLDELEKAITTQNVNTKCITIPRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 871886 - protein, 320 aa, Homo sapiens
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 871887 - protein, 320 aa, Homo sapiens; identical to SEQ ID NO: 871886

SEQ ID NO: 871888 - protein, 274 aa, Homo sapiens
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 871889 - protein, 425 aa, Homo sapiens; identical to SEQ ID NO: 871885

SEQ ID NO: 871890 - protein, 425 aa, Homo sapiens; identical to SEQ ID NO: 871885

SEQ ID NO: 871891 - protein, 230 aa, Homo sapiens
MNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 871892 - protein, 344 aa, Homo sapiens
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPTGAQDLISKLLRHNPSERLPLAQVSAHPWVRANSRRVLPPSALQSVA

SEQ ID NO: 871893 - protein, 344 aa, Homo sapiens; identical to SEQ ID NO: 871892

SEQ ID NO: 871894 - protein, 344 aa, Homo sapiens; identical to SEQ ID NO: 871892

SEQ ID NO: 871895 - protein, 344 aa, Homo sapiens; identical to SEQ ID NO: 871892

SEQ ID NO: 871896 - protein, 341 aa, Homo sapiens
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPTGAQDLISKLCLPLPFNLSPDGPCHSLGCVCLYVCVCIGERRDP

SEQ ID NO: 871897 - protein, 303 aa, Homo sapiens
MSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPTGAQDLISKLLRHNPSERLPLAQVSAHPWVRANSRRVLPPSALQSVA

SEQ ID NO: 871898 - protein, 366 aa, Homo sapiens
KGERGRRPRTADHCVPSLGGPEGEPYPWPRPTDGPTGEAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPTGAQDLISKLLRHNPSERLPLAQVSAHPWVRANSRRVLPPSALQSVA

SEQ ID NO: 871899 - protein, 164 aa, Homo sapiens [sequence omitted]

SEQ ID NO: 871900 - protein, 176 aa, Homo sapiens
MTLRLGVLWAKIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPTGAQDLISKLLRHNPSERLPLAQVSAHPWVRANSRRVLPPSALQSVA

SEQ ID NO: 871901 - protein, 344 aa, Homo sapiens; identical to SEQ ID NO: 871892

SEQ ID NO: 871902 - protein, 344 aa, Homo sapiens; identical to SEQ ID NO: 871892

SEQ ID NO: 871903 - protein, 344 aa, Homo sapiens; identical to SEQ ID NO: 871892

SEQ ID NO: 871904 - protein, 303 aa, Homo sapiens; identical to SEQ ID NO: 871897

SEQ ID NO: 871905 - protein, 312 aa, Homo sapiens [sequence omitted]

SEQ ID NO: 871906 - protein, 440 aa, Homo sapiens
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLQYGLMPPEPKPLCSLTPSSSFSPNFIQIAFSVAMASEPHLALSPGKPWIQKSASSFPLPLPALVSPAWATSDPSLLLSSFPALLCLWPEASSVSSPSHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPTGAQDLISKLLRHNPSERLPLAQVSAHPWVRANSRRVLPPSALQSVA

SEQ ID NO: 871907 - protein, 163 aa, Homo sapiens
YEEKQQQTEVRFPSFQRTTVGKGEPSCEVGGEHWQGETFLTPLFPGVFDPGNEKKFDPGLVLSLDLRNLTFSFHKVLPGKDQLPILSPGQPLQPLLVNLACQETKPTLPHWAWLLYSVPSTGEKASSSIHPYSFPGQPGSKPISYISLCRCQCMLWLLAKSWF

SEQ ID NO: 871908 - protein, 761 aa, Homo sapiens
HARGQRPRLESPQSPGGSSWWTPLSCRTSGTPPRPLPSFPSAPPQRLSRWVDSAQTARPRGRCACGRGSTPLVVAWRCAGGGGDITRDSRSAVGMIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKADATQAREGPSRETSPREAPASGWAALGLSYKVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKGFSRQSSLLFKILSSVRNHQINSDLAQLLLRLDYNKYYTQAGGTLGSFGM

SEQ ID NO: 871909 - protein, 782 aa, Homo sapiens
HARGQRPRLESPQSPGGSSWWTPLSCRTSGTPPRPLPSFPSAPPQRLSRWVDSAQTARPRGRCACGRGSTPLVVAWRCAGGGGDITRDSRSAVGMIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKADATQAREGPSRETSPREAPASGWAALGLSYKVQWPLHILFTPAVLEKNRQFYKPNRMGLSSASLPTNRYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKGFSRQSSLLFKILSSVRNHQINSDLAQLLLRLDYNKYYTQAGGTLGSFGM

SEQ ID NO: 871910 - protein, 727 aa, Homo sapiens
HARGQRPRLESPQSPGGSSWWTPLSCRTSGTPPRPLPSFPSAPPQRLSRWVDSAQTARPRGRCACGRGSTPLVVAWRCAGGGGDITRDSRSAVGMIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKADATQAREGPSRETSPREAPASGWAALGLSYKVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKVRLPGSMQPCRKDRGL

SEQ ID NO: 871911 - protein, 243 aa, Homo sapiens
AKPIRAGSEAWVVVTIEYHGKEHTDATQAREGPSRETSPREAPASGWAALGLSYKVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKVRLPGSMQPCRKDRGGFANGEFMIFPLSQ

SEQ ID NO: 871912 - protein, 761 aa, Homo sapiens; identical to SEQ ID NO: 871908

SEQ ID NO: 871913 - protein, 203 aa, Homo sapiens
HARGQRPRLESPQSPGGSSWWTPLSCRTSGTPPRPLPSFPSAPPQRLSRWVDSAQTARPRGRCACGRGSTPLVVAWRCAGGGGDITRDSRSAVGMIHELLLALSGYPGSIFTWNKRSGLQVSQDFPFLHPSETSVLNRLCRLGTDYIRFTEFIEQYTGHVQQQVGPVLCGCTPLEGRSYVKLSPLEGRSYVKLSVNLSVIHVK

SEQ ID NO: 871914 - protein, 568 aa, Homo sapiens
HARGQRPRLESPQSPGGSSWWTPLSCRTSGTPPRPLPSFPSAPPQRLSRWVDSAQTARPRGRCACGRGSTPLVVAWRCAGGGGDITRDSRSAVGMIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKADATQAREGPSRETSPREAPASGWAALGLSYKVQWPLHILFTPAVLEK

SEQ ID NO: 871915 - protein, 70 aa, Homo sapiens
LEVDGRRIRFTGSAEGNGLAVVILTVMLVGSDLHSLMFPESTGCLYPDFQSQLICSYPSEQTIPNATNLR

SEQ ID NO: 871916 - protein, 523 aa, Homo sapiens [sequence omitted]

SEQ ID NO: 871917 - protein, 330 aa, Homo sapiens
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPLKSWARCRDF

SEQ ID NO: 871918 - protein, 108 aa, Homo sapiens
MVGHQECIMEEDNRAPQLWRKTLTAPAPFADETNCQCQAPHEKLTIAQARLGTPADRPVRVYADGIFDLFAHIVRASNSVVGRHEEDKMRVDVEEERREWITTLDAGR

SEQ ID NO: 871919 - protein, 203 aa, Homo sapiens [sequence omitted]

SEQ ID NO: 871920 - protein, 311 aa, Homo sapiens
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWSGCSLNLLLLRP

SEQ ID NO: 871921 - protein, 369 aa, Homo sapiens
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 871922 - protein, 203 aa, Homo sapiens [sequence omitted]

SEQ ID NO: 871923 - protein, 203 aa, Homo sapiens [sequence omitted]

SEQ ID NO: 871924 - protein, 174 aa, Homo sapiens
SAPQSVSCASAWVARGCPEMTQIHTPASCSPVACWVSVHGSICWKHLLFLSILAFVPSLAGLPWEAGAVSSWVRSPRAVLGQVSSGWMCAGGVWRTLQSMHRSPSATLTHPQGESAACRHRAAENWVHTAPLGPHCISAPEWRCREARCVPGAVGQWFPRWGVGTSKGSDKRKT

SEQ ID NO: 871925 - protein, 182 aa, Homo sapiens
NFLNLAKRKRERKKPYRFKKLSEAGCGGSHLWGPRWVDRLSPGVQDQPGQHSETPVERERGEKLNGTLNMINSKKSTLKHLFFWRQIIAVSPRLECSGTISAHSNLCLLGSRDSSASTSPSSWDYKHMLPCPAHFFCISVETGFHRIAQADLELLSSGDLASSASQSARITGGSHRSRPKTS

SEQ ID NO: 871926 - protein, 85 aa, Homo sapiens
AVNSRRRLSGSPAGSPESHAMACRSQAPVWMKSLFLCALIPWGCLWSSLLSFPVSEIVITPLDSPFNGCQNHCTQISCRQQQGFQ

SEQ ID NO: 871927 - protein, 414 aa, Homo sapiens [sequence omitted]

SEQ ID NO: 871928 - protein, 255 aa, Homo sapiens
MASGDTLYIATDGSEMPAEIVELHEIEVETIPVETIETTVVGEEEEEDDDDEDGGGGDHGGGGGHGHAGHHHHHHHHHHHPPMIALQPLVTDDPTQVHHHQEVILVQTREEVVGGDDSDGLRAEDGFEDQILIPVPAPAGGDDDYIEQTLVTVAAAGKSGGGGSSSSGGGRVKKGGGKKSGKKSYLSGGAGAAGGGGADPRATRSGSRSRCRSRPWRASSRSPCGPQMKKKILTMRQWLKNRSLERTHLLIIQNI

SEQ ID NO: 871929 - protein, 255 aa, Homo sapiens; identical to SEQ ID NO: 871928

SEQ ID NO: 871930 - protein, 184 aa, Homo sapiens
MWARHKNPRGRWVLFSPHHRGCFTRVVTTLSFSPHVRDMRESSNSPHPLRGGRIPLPLRPTRVFRERVGRDTLWRGTRPPPRSPLCHTSLPLCPKTSFSLERTCPPRRSVLTRPRSFCGHTRETSCPPLQRKCLEIWRALDNIFAEGLDGHGRNAALEPRRAGGLCTLKPSGSHPLAHSHTLWV

SEQ ID NO: 871931 - protein, 64 aa, Homo sapiens
RQSRLYWGDRAAPHAPAAPRAAPESNKKWEQKQVQIKTLEGEFSVTMWSSGERRPRAPAPGCFC

SEQ ID NO: 871932 - protein, 255 aa, Homo sapiens; identical to SEQ ID NO: 871928

SEQ ID NO: 871933 - protein, 255 aa, Homo sapiens; identical to SEQ ID NO: 871928

SEQ ID NO: 871934 - protein, 255 aa, Homo sapiens; identical to SEQ ID NO: 871928

SEQ ID NO: 871935 - protein, 255 aa, Homo sapiens; identical to SEQ ID NO: 871928

SEQ ID NO: 871936 - protein, 255 aa, Homo sapiens; identical to SEQ ID NO: 871928

SEQ ID NO: 871937 - protein, 121 aa, Homo sapiens
MTLIFHHQVFHGNHFQKVQAIFLFHEMMQQTFNLFSTKDSSDTWDETLLDKFYTELYQQLNDLEACVMEKVGVEETPLRNVDSILAVRKYFQRITLYLTKKKYSPCSWEAVRAEIMRSFSL

SEQ ID NO: 871938 - protein, 160 aa, Homo sapiens
MADEEKLPPGWEKRMSRPSGRGYYFNHITNPSQWERPSGNSSSGGKIWQGEPARVRRSHLLVKPVKAALDLAEEITRTKEEALELISGYIQKIKAGEKDFESPASQFSDCSSAKARGDLGAFSKGQMQKPFEDPWFARRTGEMSGTVFTDSGIHVIVRTE

SEQ ID NO: 871939 - protein, 112 aa, Homo sapiens
MALNKNHSEGGGVIANGMYPCPPGYPYPPPPPEFYPGPPMMDGAMGYVQPPPPPYPGPMEPPVSGPDVPSTPAAEAKAAEAAASAYYNPGNPHNVYMPTRPAAATSLLPTGR

SEQ ID NO: 871940 - protein, 271 aa, Homo sapiens
AKKGRKLSCVLSRGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGTLTCPAGLMSIPRQSPMECTPALLATPIPPPPPEFYPGPPMMDGAMGYVQPPPPPYPGPMEPPVSGPDVPSTPAAEAKAAEAAASAYYNPGNPHNVYMPTSQTASPV

SEQ ID NO: 871941 - protein, 116 aa, Homo sapiens
VKLNEGEGGRGGGWEGSASYKLTFTAGGAIEFGQRMLQVASQEFYPGPPMMDGAMGYVQPPPPPYPGPMEPPVSGPDVPSTPAAEAKAAEAAASAYYNPGNPHNVYMPTSQTASPV

SEQ ID NO: 871942 - protein, 277 aa, Homo sapiens
AKKGRKLSCVLSRGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGTLTCPAGLMSIPRQSPMECTPALLATPIPPPPPEFYPGPPMMDGAMGYVQPPPPPYPGPMEPPVSGPDVPSTPAAEAKAAEAAASAYYNPGNPHNVYMPTRPAAATSLLPTGR

SEQ ID NO: 871943 - protein, 161 aa, Homo sapiens
AKKGRKLSCVLSRGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQGIQAPKIRG

SEQ ID NO: 871944 - protein, 98 aa, Homo sapiens
TLDLATLLWRKQVPCGPYSSIQAPVLSAPEFLFGIQEELGHPHGLKGYGQRPVFPLFNESGSWIPPRSLPKDPQRKGAIVRGSGCLPVWSFDGLEAPR

SEQ ID NO: 871945 - protein, 399 aa, Homo sapiens
PGVPGAAGCGLPLRRVRSGHEKRTVDLPPASSSAMWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 871946 - protein, 374 aa, Homo sapiens
PGVPGAAGCGLPLRRVRSGHEKRTVDLPPASSSAMWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLTNWQVPCSLLTTVCP

SEQ ID NO: 871947 - protein, 399 aa, Homo sapiens; identical to SEQ ID NO: 871945

SEQ ID NO: 871948 - protein, 158 aa, Homo sapiens
PGPARRSAGLLRPECAAAGPGGRSRARGAAAGRSGRAAAAPWTPVSSLSSSLTEWPPPKCCQPRKPPALTMSIMDHSPTTGVVTVIVILIAIAALGALILGCWCYLRLQRISQSEDEESIVGDGETKEPFLLVQYSAKGPCVERKAKLMTPNGPEVHG

SEQ ID NO: 871949 - protein, 139 aa, Homo sapiens
ARVPTPVLFRKVVLLRLLNYESQTPVSSLSSSLTEWPPPKCCQPRKPPALTMSIMDHSPTTGVVTVIVILIAIAALGALILGCWCYLRLQRISQSEDEESIVGDGETKEPFLLVQYSAKGPCVERKAKLMTPNGPEVHG

SEQ ID NO: 871950 - protein, 158 aa, Homo sapiens; identical to SEQ ID NO: 871948

SEQ ID NO: 871951 - protein, 76 aa, Homo sapiens
EILSVAVSSGVEEGENSEDLHFQAQSSGLLLRLKAPPLASPKPLLKTMLNESTFWNPEAGEVGSCSFKQHTPKLGV

SEQ ID NO: 871952 - protein, 158 aa, Homo sapiens; identical to SEQ ID NO: 871948

SEQ ID NO: 871953 - protein, 128 aa, Homo sapiens
GNGQRPRSKTGVWRLAGLGTAELADFRSGPPLTAEGRRVRSLAEERAQYVTCSSPNDVDLSSLSSEVGTVLPEKGCSGACLRRDAWKCPAEYEWGDGLAGRSSPGKLTVGWVVERSPRASADLAASRT

SEQ ID NO: 871954 - protein, 128 aa, Homo sapiens; identical to SEQ ID NO: 871953

SEQ ID NO: 871955 - protein, 169 aa, Homo sapiens
GDHWEQLIPGPCFARGRALLHSQLLTPVARTPNESGCDEPHSPGVAHSFCHVPGPTGPHGVGHPSAPRAGKAHLKRAILGQEEALRLHALCRVLREVDLLRAVISQTLQRSLAKYAELDREDDFCEAAEAPDIQREQPGPVWVAASLARVGAFVLEKGRLIALKMQSPR

SEQ ID NO: 871956 - protein, 753 aa, Homo sapiens
MGEHSPDNNIIYFEAEEDELTPDDKMLRFVDKNGLVPSSSGTVYDRTTVLIEQDPGTLEDEDDDGQCGEHLPFLVGGEEGFHLIDHEAMSQGYVQHIISPDQIHLTINPGSTPMPRNIEGATLTLQSECPETKRKEVKRYQCTFEGCPRTYSTAGNLRTHQKTHRGEYTFVCNQEGCGKAFLTSYSLRIHVRVHTKEKPFECDVQGCEKAFNTLYRLKAHQRLHTGKTFNCESEGCSKYFTTLSDLRKHIRTHTGEKPFRCDHDGCGKAFAASHHLKTHVRTHTGERPFFCPSNGCEKTFSTQYSLKSHMKGHDNKGHSYNALPQHNGSEDTNHSLCLSDLSLLSTDSELRENSSTTQGQDLSTISPAIIFESMFQNSDDTAIQEDPQQTASLTESFNGDAESVSDVPPSTGNSASLSLPLVLQPGLSEPPQPLLPASAPSAPPPAPSLGPGSQQAAFGNPPALLQPPEVPVPHSTQFAANHQEFLPHPQAPQPIVPGLSVVAGASASAAAVASAVAAPAPPQSTTEPLPAMVQTLPLGANSVLTNNPTITITPTPNTAILQSSLVMGEQNLQWILNGATSSPQNQEQIQQASKVEKVFFTTAVPVASSPGSSVQQIGLSVPVIIIKQEEACQCQCACRDSAKERASSRRKGCSSPPPPEPSPQAPDGPSLQLPAQTFSSAPVPGSSSSTLPSSCEQSRQAETPSDPQTETLSAMDVSEFLSLQSLDTPSNLIPIEALLQGEEEMGLTSSFSK

SEQ ID NO: 871957 - protein, 753 aa, Homo sapiens; identical to SEQ ID NO: 871956

SEQ ID NO: 871958 - protein, 88 aa, Homo sapiens
ALTRYQMLFRHMFYCKHVERQLCSVWISNKTAKQHSLHSAQWFAGAFTLRQRMLNFVQNIQYYMMFEVMEPTWHILEKNLKSVSFSST

SEQ ID NO: 871959 - protein, 124 aa, Homo sapiens
SVSRRARAPGRLGPESGTESAFRRAAMNLRERRWEAQGCPAQLDAHRESRGRPSGERGLSVSTRCLFVFFTLRFVPSPHFLSVSTILLGDVANREPLRLSFGKPCGNALAPVVLRVLPCVTSGL

SEQ ID NO: 871960 - protein, 185 aa, Homo sapiens
MPRLFLFHLLEFCLLLNQFSRAVAAKWKDDVIKLCGRELVRAQIAICGMSTWSKRSLSQEDAPQTPRPVAEIVPSFINKDTETIIIMLEFIANLPPELKAALSERQPSLPELQQYVPALKDSNLSFEEFKKLIRNRQSEAADSNPSELKYLGLDTHSQKKRRPYVALFEKCCLIGCTKRSLAKYC

SEQ ID NO: 871961 - protein, 117 aa, Homo sapiens
MPRLFLFHLLEFCLLLNQFSRAVAAKWKDDVIKLCGRELVRAQIAICGMSTWSKRSLSQEDAPQTPRPVAGDFIQTVSLGISPDGGKALRTGSCFTREFLGALSKLCHPSSTKIQKP

SEQ ID NO: 871962 - protein, 185 aa, Homo sapiens; identical to SEQ ID NO: 871960

SEQ ID NO: 871963 - protein, 142 aa, Homo sapiens [sequence omitted]

SEQ ID NO: 871964 - protein, 72 aa, Homo sapiens
GTPAFPRKRSDFHNHRAQAHRPQLLSPPTRSDPLTAKCLTTAQKLYSDNEAAWLKLLHGEVQDPQQGLRGCL

SEQ ID NO: 871965 - protein, 101 aa, Homo sapiens
FWEFLLNIKKLPPGSTGGSGSSLVIAVSKAWALANRKKQAEKTYQAGLLVRDLADIQPAVWWPIRYIRHALNPSFGSGQVTGHTGFRPPGLRELGVAIRPV

SEQ ID NO: 871966 - protein, 107 aa, Homo sapiens
QVVHFTLLSRQLQFEATSMTVIPLFHLAYILIILFAVTSCYCCCKFWIKSIICEPQEQGGLAHPTLKKMRVFRVVSMSSSILTLLHSEPSWPPRSPLLNPSAALIIS

SEQ ID NO: 871967 - protein, 162 aa, Homo sapiens
MTTPNKGNKALKVKREPGENGTSLTDEELVTMSVRELNQHLRGLSKEEIVQLKQRRRTLKNRGYAASCRVKRVTQKEELEKQKAELQQEVEKLASENASMKLELDALRSKYEALQTFARTVARSPVAPARGPLAAGLGPLVPGKVAATSVITIVKSKTDARS

SEQ ID NO: 871968 - protein, 162 aa, Homo sapiens; identical to SEQ ID NO: 871967

SEQ ID NO: 871969 - protein, 327 aa, Homo sapiens
CACALSGRACNPRVRAHDRQTRAVSGTRCGAPGPEPGLFSTQVFRAPRSAMSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 871970 - protein, 327 aa, Homo sapiens; identical to SEQ ID NO: 871969

SEQ ID NO: 871971 - protein, 170 aa, Homo sapiens
CACALSGRACNPRVRAHDRQTRAVSGTRCGAPGPEPGLFSTQVFRAPRSAMSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKGMGRGRGLPEEEPMHWGSWRLRGP

SEQ ID NO: 871972 - protein, 327 aa, Homo sapiens; identical to SEQ ID NO: 871969

SEQ ID NO: 871973 - protein, 438 aa, Homo sapiens
CACALSGRACNPRVRAHDRQTRAVSGTRCGAPGPEPGLFSTQVFRAPRSAMSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQLGVQENEEVETRWVEAGGSNKVPIPIGAPNFVVNTCVPLEVVPPKGGAIFYPKMVPFKFIFPKKRQAYSSHIYTKKNTYVCGGRSMWGPLREKKVFSDETHIAVCGGRQGGPPQVCGTWGH

SEQ ID NO: 871974 - protein, 313 aa, Homo sapiens
CACALSGRACNPRVRAHDRQTRAVSGTRCGAPGPEPGLFSTQVFRAPRSAMSSGIHVALVTGGNKGIGLAIVRDLCRLFSGDVVLTARDGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 871975 - protein, 418 aa, Homo sapiens
CACALSGRACNPRVRAHDRQTRAVSGTRCGAPGPEPGLFSTQVFRAPRSAMSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQVVLLLRLWFTRTSKGSSSKSHLTLLSQNSKAGMNFFMQLPPHFLCVFLLELITSNCLSYENFLLQNPCKFGIHLSTGLLHTFLHNALWCILGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 871976 - protein, 329 aa, Homo sapiens
CACALSGRACNPRVRAHDRQTRAVSGTRCGAPGPEPGLFSTQVFRAPRSAMSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKANAKVDPFLALPLWSRTVSHSPGGAPRALSGPGLFKDLVA

SEQ ID NO: 871977 - protein, 327 aa, Homo sapiens; identical to SEQ ID NO: 871969

SEQ ID NO: 871978 - protein, 244 aa, Homo sapiens
FPCPVVLLSCATSKALVHQDLKGQLFQISPDSTQPKFEGRNELLHATTTTLSMRIPLRTHTSNCLSYENFLLQNPCKFGIHLSTGLLHTFLHNALWCILGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 871979 - protein, 220 aa, Homo sapiens
MERYAAALEEVADGARQQERHYQLLSALQSLVKELPSSFQQRLSYTTLSDLALALLDGTVFEIVQGLLEIQHLTEKSLYNQRLRLQNEHRVLRQALRQKHQEAQQACRPHNLPVVQAAQQRELEAVEHRIREEQRAMDQKIILELDRKVADQQSTLEKAGVAGFYVTTNPQELMLQMNLLELIRKLQQRGCRAGNAALGLGGPWQSPAAQCDQKGSPVPP

SEQ ID NO: 871980 - protein, 220 aa, Homo sapiens; identical to SEQ ID NO: 871979

SEQ ID NO: 871981 - protein, 220 aa, Homo sapiens; identical to SEQ ID NO: 871979

SEQ ID NO: 871982 - protein, 211 aa, Homo sapiens
DPRTQAHFQERHYQLLSALQSLVKELPSSFQQRLSYTTLSDLALALLDGTVFEIVQGLLEIQHLTEKSLYNQRLRLQNEHRVLRQALRQKHQEAQQACRPHNLPVVQAAQQRELEAVEHRIREEQRAMDQKIILELDRKVADQQSTLEKAGVAGFYVTTNPQELMLQMNLLELIRKLQQRGCRAGNAALGLGGPWQSPAAQCDQKGSPVPP

SEQ ID NO: 871983 - protein, 220 aa, Homo sapiens; identical to SEQ ID NO: 871979

SEQ ID NO: 871984 - protein, 129 aa, Homo sapiens
DNRKKGRDAPRSGCREAGGARRRRRRLAGVRAMERYAAALEEVADGARQQERHYQLLSALQSLVKELPSSFQQRLSYTTLSDLALALLDGTVFEIVQGLLEIQHLTEKSLYNQRLRLQNEHRGRGTPDP

SEQ ID NO: 871985 - protein, 109 aa, Homo sapiens
PGYLQGSLRGPGVPWGLATREELQHQGSSQEQSVGFHLFFWPGTPPSWGAVAIWHLLVTGASCGVLHVLFHGGLCPMIASSVHSLQTRQFAHICVCAQFSKDRGALLDG

SEQ ID NO: 871986 - protein, 221 aa, Homo sapiens
DPRVAHASDPRVADGARQQERHYQLLSALQSLVKELPSSFQQRLSYTTLSDLALALLDGTVFEIVQGLLEIQHLTEKSLYNQRLRLQNEHRVLRQALRQKHQEAQQACRPHNLPVVQAAQQRELEAVEHRIREEQRAMDQKIILELDRKVADQQSTLEKAGVAGFYVTTNPQELMLQMNLLELIRKLQQRGCRAGNAALGLGGPWQSPAAQCDQKGSPVPP

SEQ ID NO: 871987 - protein, 2155 aa, Homo sapiens
MNYSSFLRIWVSFIFALVQHQAQPRELMYPFWQNDTKTPKVDDGSSSEIKLAIPVFFFGVPYRTVYVNNNGVVSFNVLVSQFTPESFPLTDGRAFVAPFWADVHNGIRGEIYYRETMEPAILKRATKDIRKYFKDMATFSATWVFIVTWEEVTFYGGSSTTPVNTFQAVLVSDGSYTFTLFNYYEINWTTGTASGGDPLTGLGGVMAQAGFNGGNLTNFFSLPGSRTPEIVNIQETTNVNVPGRWAFKVDGKEIDPANGCTSRGQFLRRGEVFWDDLNCTVKCRCLDFNNEIYCQEASCSPYEVCEPKGKFFYCSAVETSTCVVFGEPHYHTFDGFLFHFQGSCAYLLARQCLQTSSLPFFSVEAKNEHRGGSAVSWVKELSVEVNGYKILIPKGSYGRVKVNDLVTSLPVTLDLGTVKIYQSGISTAVETDFGLLVTFDGQHYASISVPGSYINSTCGLCGNYNKNPLDDFLRPDGRPAMSVLDLGESWRVYHADWKCDSGCVDNCTQCDAATEALYFGSDYCGFLNKTDGPLWECGTVVDPTAFVHSCVYDLCSVRDNGTLLCQAIQAYALVCQALGIPIGDWRTQTGCVSTVQCPSFSHYSVCTSSCPDTCSDLTASRNCATPCTEGCECNQGFVLSTSQCVPLHKCGCDFDGHYYTMGEFFWATANCTVQCLCEEGGDVYCFNKTCGSGEVCAVEDGYQGCFPKRETVCLLSQNQVLHTFDGASYAFPSEFSYTLLKTCPERPEYLEIDINKKKPDAGPAWLRGLRILVADQEVKIGGIGASEVKLNGQEVELPFFHPSGKLEIYRNKNSTTVESKGVVTVQYSDIGLLYIRLSTTYFNCTGGLCGFYNANASDEFCLPNGKCTDNLAVFLESWTTFEEICNGECGDLLKACNNDSELLKFYRSRSRCGIINDPSNSSFLECHGVVNVTAYYRTCLFRLCQSGGNESELCDSVARYASACKNADVEVGPWRTYDFCPLECPENSHFEECITCTETCETLTLGPICVDSCSEGCQCDEGYALLGSQCVTRSECGCNFEGHQLATNETFWVDLDCQIFCYCSGTDNRVHCETIPCKDDEYCMEEGGLYYCQARTDASCIVSGYGHYLTFDGFPFDFQTSCPLILCTTGSRPSSDSFPKFVVTAKNEDRDPSLALWVKQVDVTVFGYSIVIHRAYKHTVLVNSERLYLPLKLGQGKINIFSFGFHVVVETDFGLKVVYDWKTFLSITVPRSMQNSTYGLCGRYNGNPDDDLEMPMGLLASSVNEFGQSWVKRDTFCQVGCGDRCPSCAKVEGFSKVQQLCSLIPNQNAAFSKCHSKVNPTFFYKNCLFDSCIDGGAVQTACSWLQNYASTCQTQGITVTGWRNYTSCTVTCPPNSHYESCVSVCQPRCAAIRLKSDCSHYCVEGCHCDAGYVLNGKSCILPHSCGCYSDGKYYEPKQLFWNSDCTRRCRCFRRNVIQCDPRQCKSDEECALRNGVRGCFSTKTSYCLAAGGGVFRTFDGAFLRFPANCAFVLSTICQKLPDISFQLIINFDKWSAPNLTIISPVYFYINEEQILINDRNTVKVNGTQVNVPFITGLATKIYSSEGFLVIDTSPDIQIYYNGFNVIKISISERLQNKVCGLCGNFNGDLTDDYVTLRGKPVVSSVVLAQSWKTNGMQKRPLAPSCNELQFSQYAAMCDNVHIQKMQGDGYCLKLTDMKGFFQPCYGLLDPLPFYESCYLDGCYSHKKFQLCGSLAAYGEACRSFGILSTEWIEKENCSGVVEDPCVGADCPNRTCELGNGRELCGCIEPPPYGNNSHDIIDAEVTCKAAQMEVSISKCKLFQLGFEREGVRINDRQCTGIEGEDFISFQINNTKGNCGNIVQSNGTHIMYKNTLWIESANNTGNIITRDRTINVEFSCAYELDIKISLDSVVKPMLSVINLTVPTQEGSFITKMALYKNASYKHPYRQGEVVLTTRDVLYVGVFVVGADATHLILTLNKCYATPTRDSNDKLRYFIIEGGCQNLKDNTIGIEENAVSLTCRFHVTVFKFIGDYDEVHLHCAVSLCDSEKYSCKITCPHNSRIATDYTKEPKEQIISVGPIRRKRLDWCEDNGGCEQICTSRVDGPLCSCVTGTLQEDGKSCRASNSSMELQVWTLLLIMIQISLWHFVYKSGTTS

SEQ ID NO: 871988 - protein, 110 aa, Homo sapiens
SCSKTDSTDLPFVITVPTDSHDIIDAEVTCKAAQMEVSISKCKLFQLGFEREGVRINDRQCTGIEGEDFISFQINNTKGNCGNIVQVRKAAGKSTWQRQRQLRVFAHLLS

SEQ ID NO: 871989 - protein, 238 aa, Homo sapiens
QVLGVKASTFLLGGHSVTHNRGSLETMSIKEKWIKEVNSERLYLPLKLGQGKINIFSFGFHVVVETDFGLKVVYDWKTFLSITVPRSMQNSTYGLCGRYNGNPDDDLEMPMGLLASSVNEFGQSWVKRDTFCQVGCGDRCPSCAKVEGFSKVQQLCSLIPNQNAAFSKCHSKVNPTFFYKNCLFDSCIDGGAVQTACSWLQNYASTCQTQGITVTGWRNYTSCSESFSLSLLVASPLS

SEQ ID NO: 871990 - protein, 1001 aa, Homo sapiens
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 871991 - protein, 1001 aa, Homo sapiens; identical to SEQ ID NO: 871990

SEQ ID NO: 871992 - protein, 321 aa, Homo sapiens
SRPAEADPCSCLRSGCGPGRLSFTHHPPNLGRASVLWSSLDTLVWLLCQGLKEVPSWQMGASLASFGKLKVAAVTFLILQLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKLRLTALLYTAEGAALQCSRFCSRGGADRPESARAGLGPSRY

SEQ ID NO: 871993 - protein, 168 aa, Homo sapiens
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPIADCRIADTTLPVKPGPLG

SEQ ID NO: 871994 - protein, 1001 aa, Homo sapiens; identical to SEQ ID NO: 871990

SEQ ID NO: 871995 - protein, 1036 aa, Homo sapiens
GLWRRGGRDPAGDGSTASSRLTPLRGPCIAPAAAAMSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 871996 - protein, 645 aa, Homo sapiens
ALNPVADPIWASLPQVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 871997 - protein, 1008 aa, Homo sapiens
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQPGLLLPQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 871998 - protein, 373 aa, Homo sapiens
LKDLLMLSREGRVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 871999 - protein, 338 aa, Homo sapiens
SRPAEADPCSCLRSGCGPGRLSFTHHPPNLGRASVLWSSLDTLVWLLCQGLKEVPSWQMGASLASFGKLKVAAVTFLILQLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 872000 - protein, 117 aa, Homo sapiens
MQSLPSASTFSASSACGAAMRPARGSAPSATRPLVPTTSIVSTSAEPETQGTLEHHGPWGLCPHLLPTPGLVAPPSIPDPMGPAPAHLVGLGTLVHASGHGISQASFHLFLKVRAAA

SEQ ID NO: 872001 - protein, 865 aa, Homo sapiens
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLLEMLTGSSRVDRTQ

SEQ ID NO: 872002 - protein, 901 aa, Homo sapiens
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKSDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 872003 - protein, 1026 aa, Homo sapiens
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVWPPPACRLELERWGSCPESSSGPEVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 872004 - protein, 1052 aa, Homo sapiens
RKKKTRKKIRSERRSVIIQARGLSLLSGDGSTASSRLTPLRGPCIAPAAAAMSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 872005 - protein, 922 aa, Homo sapiens
GLGTRPGWSCTLLIVTRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 872006 - protein, 920 aa, Homo sapiens
MAWCGARHTPHRGLATVAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 872007 - protein, 407 aa, Homo sapiens
CPLRDSGIPGPAFSGETEQPAELGREVQLDITVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 872008 - protein, 334 aa, Homo sapiens
CSATLQDPLPVLPQEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 872009 - protein, 799 aa, Homo sapiens
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKEVPSWQMGASLASFGKL

SEQ ID NO: 872010 - protein, 377 aa, Homo sapiens
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVGCCRG

SEQ ID NO: 872011 - protein, 68 aa, Homo sapiens
ALPRGPPPWGPAPVGPGAPIQGKRKQMNAGHQVVRMLLSASGHLDPEWSGRQIGGGEGCQDVSKNEVF

SEQ ID NO: 872012 - protein, 457 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAELHRRSQAPGSTQTSRSRPYTEIAWGG

SEQ ID NO: 872013 - protein, 121 aa, Homo sapiens
ETESHSVTQAGVQWSDLGSLQLPPPGSKRFSCLSLLSSWDYKAVRGRQPGRGLNETLLQDLNSAITYRITNHSHFRMEGEVVLTTTTLAQAGAFYAECGAGQAGISKGVGLKDVSRRDKPL

SEQ ID NO: 872014 - protein, 896 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEKAGPFRDEAAWAHTLSTDQLMMGTLGQRLPTWPQSPHLWGRTVTADLSTPQEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 872015 - protein, 651 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 872016 - protein, 679 aa, Homo sapiens
MTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 872017 - protein, 834 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 872018 - protein, 736 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPRRCP

SEQ ID NO: 872019 - protein, 655 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSSPPLCCHRGGKVYVVLGRRRKEESPVLSPSSVL

SEQ ID NO: 872020 - protein, 347 aa, Homo sapiens
PCYEQLNRKAEGKATSTTELPPEYLISRLSQQLPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 872021 - protein, 845 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 872022 - protein, 138 aa, Homo sapiens
SELQHDAYELDVADDVVSVRTMAPTNQPHPVGAQYRPQSQEPLSRCPPVWEPAPPTNQPHPVGAQHRPQRQEPLSRCPPVWEPAPPTNQPHPVGAQHRPQSQEPLSRCPSARAPHLQVAPTLLPSLPDSGHWLVWETL

SEQ ID NO: 872023 - protein, 651 aa, Homo sapiens; identical to SEQ ID NO: 872015

SEQ ID NO: 872024 - protein, 845 aa, Homo sapiens; identical to SEQ ID NO: 872021

SEQ ID NO: 872025 - protein, 647 aa, Homo sapiens
MTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 872026 - protein, 663 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGSTHSVAFPP

SEQ ID NO: 872027 - protein, 83 aa, Homo sapiens
FWGSGDPGHPLSSCPGAHVVPSALCLGACDLSPLVDPALVQLGPNDCPSFWQWAGPAGQREPPWQKPVVKDHKLAASGWGEGR

SEQ ID NO: 872028 - protein, 247 aa, Homo sapiens
MGHTGPLSQGQQSLRFGRQPRPGWNPSVPSLAQVGTGNAWGTQQCGDDDVFHCDPGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 872029 - protein, 69 aa, Homo sapiens
QGTAEAGRAEVIPGAWAMLHELFLQEEVSLQLGPESTVDQDWTGSKALERPPGMCACASAPRMQLRPAH

SEQ ID NO: 872030 - protein, 130 aa, Homo sapiens
GREGLLSRPKGTISNFGYKFPFTSEFLFPGCFSPLDACGGGDGRASDTARGSLSGYFSHPAKLLETSKETRPVSTQASGKCRPPVWELSSPLLTHRSALTHRDGEWGSSSAAFHRQRGHIPFQQSLWPRC

SEQ ID NO: 872031 - protein, 230 aa, Homo sapiens
LQSGDWERRGSGSESAHKTQRALDDCKMLVQEFNTQVALYRELVISIGDVSVSCPSLRAEMHKTRTKGCEMARQAHQKLAAISGPEDGEIHPEICRLYIQLQCCLEMYTTEMLKSICLLGSLQFHRKGKEPGGGTKSLDCKIEESAETPALEDSSSSPVDSQQHSWQVSTDIENTERDMREMKNLLSKLRETMPLPLKNQDDSSLLNLTPYPLVRRRKRRFFGLCCLVSS

SEQ ID NO: 872032 - protein, 143 aa, Homo sapiens
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKAKKGKGKD

SEQ ID NO: 872033 - protein, 143 aa, Homo sapiens; identical to SEQ ID NO: 872032

SEQ ID NO: 872034 - protein, 143 aa, Homo sapiens; identical to SEQ ID NO: 872032

SEQ ID NO: 872035 - protein, 143 aa, Homo sapiens; identical to SEQ ID NO: 872032

SEQ ID NO: 872036 - protein, 143 aa, Homo sapiens; identical to SEQ ID NO: 872032

SEQ ID NO: 872037 - protein, 143 aa, Homo sapiens; identical to SEQ ID NO: 872032

SEQ ID NO: 872038 - protein, 143 aa, Homo sapiens; identical to SEQ ID NO: 872032

SEQ ID NO: 872039 - protein, 143 aa, Homo sapiens; identical to SEQ ID NO: 872032

SEQ ID NO: 872040 - protein, 143 aa, Homo sapiens; identical to SEQ ID NO: 872032

SEQ ID NO: 872041 - protein, 165 aa, Homo sapiens
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKGQRKEKGVGLSRGAAPPPPPPVRGQFQVKP

SEQ ID NO: 872042 - protein, 165 aa, Homo sapiens; identical to SEQ ID NO: 872041

SEQ ID NO: 872043 - protein, 165 aa, Homo sapiens; identical to SEQ ID NO: 872041

SEQ ID NO: 872044 - protein, 143 aa, Homo sapiens; identical to SEQ ID NO: 872032

SEQ ID NO: 872045 - protein, 274 aa, Homo sapiens
LRPVLETKGAAAAGAGRARRGRERSSAGSERVSARRPLVRPAAADLGAGGWRRGWGSELRPGLEASPGESPLSGASGLAARGRPKSSHRRHLSSPTWGLESGARGGGRALHAAPGGEGDGPGIQTRALPSGMQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKAKKGKGKD

SEQ ID NO: 872046 - protein, 143 aa, Homo sapiens; identical to SEQ ID NO: 872032

SEQ ID NO: 872047 - protein, 321 aa, Homo sapiens
MRSTTLLLVAKFVVIPGNELDKVVVEGNASPSVKGGGVGVAVEVRGDHLVLSVAQDALEGAPDACFTTFLMSSYLAGFSRRQVRSTTDTLAVGTRKAMPVSFPFSSGMTLPTALAAPVEAGMMFWRAPRPSRHSFPEGPSTVFWVAVMAWTVVMSPSTIPKLSWMPGPGIQTRALPSGMQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKAKKGKGKD

SEQ ID NO: 872048 - protein, 143 aa, Homo sapiens; identical to SEQ ID NO: 872032

SEQ ID NO: 872049 - protein, 165 aa, Homo sapiens; identical to SEQ ID NO: 872041

SEQ ID NO: 872050 - protein, 143 aa, Homo sapiens; identical to SEQ ID NO: 872032

SEQ ID NO: 872051 - protein, 310 aa, Homo sapiens
GHEVHHPVAVAKFVVIPGNELDKVVVEGNASPSVKGGGVGVAVEVRGDHLVLSVAQDALRGPSDACFTTFLMSSYLAGFSRRQVRSTTDTLAVGTRKAMPVSFPFSSGMTLPTALAAPVEAGMMFWRAPRPSRHSFPEGPSTVFWVAVMAWTVVMSPSTIPKLSWMTGPGIQTRALPSGMQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPPFSFAY

SEQ ID NO: 872052 - protein, 87 aa, Homo sapiens
AAAAAGARLQITDPHERRPCLPAILVPSLLHIYACLLHSLASECPLAVSKAFGQEGAWAASQQVYWALPSTRHCNKKWRLNHEETWL

SEQ ID NO: 872053 - protein, 148 aa, Homo sapiens
TDLPVRPSCAVLADTRSPRLSAHGGVVRPAALGGRSRRAGPRRPPMEKARRGGDGVPRGPVLHIVVVGFHHKKGCQVRKGPAPPPSRSGVRPSGPPCPASVCSARVVQSSPQRLRPFASQPDSFCSSSHPPHMKPSPHNLFLLPLKNG

SEQ ID NO: 872054 - protein, 682 aa, Homo sapiens
TDLPVRPSCAVLADTRSPRLSAHGGVVRPAALGGRSRRAGPRRPPMEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLVLFRIVNVAKKLETSWSQLAGMLYKQEKLLASQLEELFPVQRQLCLHGFPLSPLPPPKVSLSHQMRSLEQGVRGCYCFLRFKCPLSVCCSQAVTSHRSTAGDHMSNCLHGCCSK

SEQ ID NO: 872055 - protein, 675 aa, Homo sapiens
TDLPVRPSCAVLADTRSPRLSAHGGVVRPAALGGRSRRAGPRRPPMEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLDNEKILSDYGTTFVTAWKNTHNYRVWNSNKHPALAEINPNSVQNSERGKKIGNVMVTTSRNVVQTGKAVGQSVGGAFSSAKTAMSSWLSTFTTSTSQSLTEPPDEKP

SEQ ID NO: 872056 - protein, 693 aa, Homo sapiens
TDLPVRPSCAVLADTRSPRLSAHGGVVRPAALGGRSRRAGPRRPPMEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLDNEKILSDYGTTFVTAWKNTHNYRVWNSNKHPALAEINPNHPFQGQYSVSDMKLRFSHSVQNSERGKKIGNVMVTTSRNVVQTGKAVGQSVGGAFSSAKTAMSSWLSTFTTSTSQSLTEPPDEKP

SEQ ID NO: 872057 - protein, 675 aa, Homo sapiens; identical to SEQ ID NO: 872055

SEQ ID NO: 872058 - protein, 693 aa, Homo sapiens; identical to SEQ ID NO: 872056

SEQ ID NO: 872059 - protein, 675 aa, Homo sapiens; identical to SEQ ID NO: 872055

SEQ ID NO: 872060 - protein, 675 aa, Homo sapiens; identical to SEQ ID NO: 872055

SEQ ID NO: 872061 - protein, 120 aa, Homo sapiens
PLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKVKCNIFYRIP

SEQ ID NO: 872062 - protein, 245 aa, Homo sapiens
RPPGAGAASPCAAPGLPAGGATIHPGSPSAWPPRARAALRLWLGCVCFALVQADSPSAPVNVTVRHLKANSAVVSWDVLEDEVVIGFAISQQKKDVRMLRFIQEVNTTTRSCALWDLEEDTEYIVHVQAISIQGQSPASEPVLFKTPREAEKMASKNKDEVTMKEMGRNQQLRTGEVLIIVVVLFMWAGVIALFCRQYDIIKDNEPNNNKEKTKSASETSTPEHQGGGLLRSKFPNKPSVNIIEA

SEQ ID NO: 872063 - protein, 234 aa, Homo sapiens
RPPGAGAASPCAAPGLPAGGATIHPGSPSAWPPRARAALRLWLGCVCFALVQADSPSAPVNVTVRHLKANSAVVSWDVLEDEVVIGFAISQQKKDVRMLRFIQEVNTTTRSCALWDLEEDTEYIVHVQAISIQGQSPASEPVLFKTPREAEKMASKNKDEVTMKEMGRNQQLRTGEVLIIVVVLFMWAGVIALFCRQYDIIKDNEPNNNKEKTKSASETSTPEHQGGGLLRSKI

SEQ ID NO: 872064 - protein, 234 aa, Homo sapiens; identical to SEQ ID NO: 872063

SEQ ID NO: 872065 - protein, 234 aa, Homo sapiens; identical to SEQ ID NO: 872063

SEQ ID NO: 872066 - protein, 234 aa, Homo sapiens; identical to SEQ ID NO: 872063

SEQ ID NO: 872067 - protein, 234 aa, Homo sapiens; identical to SEQ ID NO: 872063

SEQ ID NO: 872068 - protein, 250 aa, Homo sapiens
RPPGAGAASPCAAPGLPAGGATIHPGSPSAWPPRARAALRLWLGCVCFALVQADSPSAPVNVTVRHLKANSAVVSWDVLEDEVVIGFAISQQKKDVRMLRFIQEVNTTTRSCALWDLEEDTEYIVHVQAISIQGQSPASEPVLFKTPREAEKMASKNKDEVTMKEMGRNQQLRTGEVLIIVVVLFMWAGVIALFCRQYDIIKDNEPNNNKEKTKSASETSTPEHQGGGLLRSKVRARPGPGWATLCLMLW

SEQ ID NO: 872069 - protein, 748 aa, Homo sapiens
MGLRTAKKRGLGGGGKWKREEGGGTRGRREVRPACFLQSGGRGDPGDVGGPAGNPGCSPHPRAATRPPPLPAHTPAHTPEWCGAASAEAAEPRRAGPHLCIPAPGLTKTPILEKVPRKMAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHMTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 872070 - protein, 630 aa, Homo sapiens
MAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHMTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 872071 - protein, 666 aa, Homo sapiens
MWPECRDEALSTVGPHLCIPAPGLTKTPILEKVPRKMAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHMTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 872072 - protein, 97 aa, Homo sapiens
GGLAMPKNAVVILRYGPYSAAGLPVEHHTFRLQGLQAVLAIDGHEVILEKIEDWNVVELMVNEEVIFHCNIKDLEFGGDGKLDPLCEKARIAVLNAY

SEQ ID NO: 872073 - protein, 263 aa, Homo sapiens
MHAYCFACNKNIFFFFFLRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 872074 - protein, 545 aa, Homo sapiens [sequence omitted]

SEQ ID NO: 872075 - protein, 545 aa, Homo sapiens [sequence omitted]

SEQ ID NO: 872076 - protein, 630 aa, Homo sapiens; identical to SEQ ID NO: 872070

SEQ ID NO: 872077 - protein, 630 aa, Homo sapiens; identical to SEQ ID NO: 872070

SEQ ID NO: 872078 - protein, 161 aa, Homo sapiens
GGLAMPKNAVVILRYGPYSAAGLPVEHHTFRLQGLQAVLAIDGHEVILEKIEDWNVVELMVNEEVIFHCNIKDLEFGKLTPSSDKRTTSSSRLTFHQLSSPCRMKVSPLQQFPQKTQDLTCTVLAQIGSCIHFQTNLCDLGWPGLDHMLISGLEKRGTQPY

SEQ ID NO: 872079 - protein, 630 aa, Homo sapiens; identical to SEQ ID NO: 872070
